United States Patent 10,611,818 (MHC MULTIMERS IN TUBERCULOSIS DIAGNOSTICS, VACCINE AND THERAPEUTICS) - sequence listing, part 7

SEQ ID NO: 198462 - protein, 14 aa, Mycobacterium tuberculosis
LPERIPYAIAMELA

SEQ ID NO: 198463 - protein, 14 aa, Mycobacterium tuberculosis
PERIPYAIAMELAL

SEQ ID NO: 198464 - protein, 14 aa, Mycobacterium tuberculosis
ERIPYAIAMELALT

SEQ ID NO: 198465 - protein, 14 aa, Mycobacterium tuberculosis
RIPYAIAMELALTG

SEQ ID NO: 198466 - protein, 14 aa, Mycobacterium tuberculosis
IPYAIAMELALTGD

SEQ ID NO: 198467 - protein, 14 aa, Mycobacterium tuberculosis
PYAIAMELALTGDN

SEQ ID NO: 198468 - protein, 14 aa, Mycobacterium tuberculosis
YAIAMELALTGDNL

SEQ ID NO: 198469 - protein, 14 aa, Mycobacterium tuberculosis
AIAMELALTGDNLP

SEQ ID NO: 198470 - protein, 14 aa, Mycobacterium tuberculosis
IAMELALTGDNLPA

SEQ ID NO: 198471 - protein, 14 aa, Mycobacterium tuberculosis
AMELALTGDNLPAE

SEQ ID NO: 198472 - protein, 14 aa, Mycobacterium tuberculosis
MELALTGDNLPAER

SEQ ID NO: 198473 - protein, 14 aa, Mycobacterium tuberculosis
ELALTGDNLPAERA

SEQ ID NO: 198474 - protein, 14 aa, Mycobacterium tuberculosis
LALTGDNLPAERAH

SEQ ID NO: 198475 - protein, 14 aa, Mycobacterium tuberculosis
ALTGDNLPAERAHE

SEQ ID NO: 198476 - protein, 14 aa, Mycobacterium tuberculosis
LTGDNLPAERAHEL

SEQ ID NO: 198477 - protein, 14 aa, Mycobacterium tuberculosis
TGDNLPAERAHELG

SEQ ID NO: 198478 - protein, 14 aa, Mycobacterium tuberculosis
GDNLPAERAHELGL

SEQ ID NO: 198479 - protein, 14 aa, Mycobacterium tuberculosis
DNLPAERAHELGLV

SEQ ID NO: 198480 - protein, 14 aa, Mycobacterium tuberculosis
NLPAERAHELGLVN

SEQ ID NO: 198481 - protein, 14 aa, Mycobacterium tuberculosis
LPAERAHELGLVNV

SEQ ID NO: 198482 - protein, 14 aa, Mycobacterium tuberculosis
PAERAHELGLVNVL

SEQ ID NO: 198483 - protein, 14 aa, Mycobacterium tuberculosis
AERAHELGLVNVLA

SEQ ID NO: 198484 - protein, 14 aa, Mycobacterium tuberculosis
ERAHELGLVNVLAE

SEQ ID NO: 198485 - protein, 14 aa, Mycobacterium tuberculosis
RAHELGLVNVLAEP

SEQ ID NO: 198486 - protein, 14 aa, Mycobacterium tuberculosis
AHELGLVNVLAEPG

SEQ ID NO: 198487 - protein, 14 aa, Mycobacterium tuberculosis
HELGLVNVLAEPGT

SEQ ID NO: 198488 - protein, 14 aa, Mycobacterium tuberculosis
ELGLVNVLAEPGTA

SEQ ID NO: 198489 - protein, 14 aa, Mycobacterium tuberculosis
LGLVNVLAEPGTAL

SEQ ID NO: 198490 - protein, 14 aa, Mycobacterium tuberculosis
GLVNVLAEPGTALD

SEQ ID NO: 198491 - protein, 14 aa, Mycobacterium tuberculosis
LVNVLAEPGTALDA

SEQ ID NO: 198492 - protein, 14 aa, Mycobacterium tuberculosis
VNVLAEPGTALDAA

SEQ ID NO: 198493 - protein, 14 aa, Mycobacterium tuberculosis
NVLAEPGTALDAAI

SEQ ID NO: 198494 - protein, 14 aa, Mycobacterium tuberculosis
VLAEPGTALDAAIA

SEQ ID NO: 198495 - protein, 14 aa, Mycobacterium tuberculosis
LAEPGTALDAAIAL

SEQ ID NO: 198496 - protein, 14 aa, Mycobacterium tuberculosis
AEPGTALDAAIALA

SEQ ID NO: 198497 - protein, 14 aa, Mycobacterium tuberculosis
EPGTALDAAIALAE

SEQ ID NO: 198498 - protein, 14 aa, Mycobacterium tuberculosis
PGTALDAAIALAEK

SEQ ID NO: 198499 - protein, 14 aa, Mycobacterium tuberculosis
GTALDAAIALAEKI

SEQ ID NO: 198500 - protein, 14 aa, Mycobacterium tuberculosis
TALDAAIALAEKIT

SEQ ID NO: 198501 - protein, 14 aa, Mycobacterium tuberculosis
ALDAAIALAEKITA

SEQ ID NO: 198502 - protein, 14 aa, Mycobacterium tuberculosis
LDAAIALAEKITAN

SEQ ID NO: 198503 - protein, 14 aa, Mycobacterium tuberculosis
DAAIALAEKITANG

SEQ ID NO: 198504 - protein, 14 aa, Mycobacterium tuberculosis
AAIALAEKITANGP

SEQ ID NO: 198505 - protein, 14 aa, Mycobacterium tuberculosis
AIALAEKITANGPL

SEQ ID NO: 198506 - protein, 14 aa, Mycobacterium tuberculosis
IALAEKITANGPLA

SEQ ID NO: 198507 - protein, 14 aa, Mycobacterium tuberculosis
ALAEKITANGPLAV

SEQ ID NO: 198508 - protein, 14 aa, Mycobacterium tuberculosis
LAEKITANGPLAVV

SEQ ID NO: 198509 - protein, 14 aa, Mycobacterium tuberculosis
AEKITANGPLAVVA

SEQ ID NO: 198510 - protein, 14 aa, Mycobacterium tuberculosis
EKITANGPLAVVAT

SEQ ID NO: 198511 - protein, 14 aa, Mycobacterium tuberculosis
KITANGPLAVVATK

SEQ ID NO: 198512 - protein, 14 aa, Mycobacterium tuberculosis
ITANGPLAVVATKR

SEQ ID NO: 198513 - protein, 14 aa, Mycobacterium tuberculosis
TANGPLAVVATKRI

SEQ ID NO: 198514 - protein, 14 aa, Mycobacterium tuberculosis
ANGPLAVVATKRII

SEQ ID NO: 198515 - protein, 14 aa, Mycobacterium tuberculosis
NGPLAVVATKRIIT

SEQ ID NO: 198516 - protein, 14 aa, Mycobacterium tuberculosis
GPLAVVATKRIITE

SEQ ID NO: 198517 - protein, 14 aa, Mycobacterium tuberculosis
PLAVVATKRIITES

SEQ ID NO: 198518 - protein, 14 aa, Mycobacterium tuberculosis
LAVVATKRIITESR

SEQ ID NO: 198519 - protein, 14 aa, Mycobacterium tuberculosis
AVVATKRIITESRG

SEQ ID NO: 198520 - protein, 14 aa, Mycobacterium tuberculosis
VVATKRIITESRGW

SEQ ID NO: 198521 - protein, 14 aa, Mycobacterium tuberculosis
VATKRIITESRGWS

SEQ ID NO: 198522 - protein, 14 aa, Mycobacterium tuberculosis
ATKRIITESRGWSP

SEQ ID NO: 198523 - protein, 14 aa, Mycobacterium tuberculosis
TKRIITESRGWSPD

SEQ ID NO: 198524 - protein, 14 aa, Mycobacterium tuberculosis
KRIITESRGWSPDT

SEQ ID NO: 198525 - protein, 14 aa, Mycobacterium tuberculosis
RIITESRGWSPDTM

SEQ ID NO: 198526 - protein, 14 aa, Mycobacterium tuberculosis
IITESRGWSPDTMF

SEQ ID NO: 198527 - protein, 14 aa, Mycobacterium tuberculosis
ITESRGWSPDTMFA

SEQ ID NO: 198528 - protein, 14 aa, Mycobacterium tuberculosis
TESRGWSPDTMFAE

SEQ ID NO: 198529 - protein, 14 aa, Mycobacterium tuberculosis
ESRGWSPDTMFAEQ

SEQ ID NO: 198530 - protein, 14 aa, Mycobacterium tuberculosis
SRGWSPDTMFAEQM

SEQ ID NO: 198531 - protein, 14 aa, Mycobacterium tuberculosis
RGWSPDTMFAEQMK

SEQ ID NO: 198532 - protein, 14 aa, Mycobacterium tuberculosis
GWSPDTMFAEQMKI

SEQ ID NO: 198533 - protein, 14 aa, Mycobacterium tuberculosis
WSPDTMFAEQMKIL

SEQ ID NO: 198534 - protein, 14 aa, Mycobacterium tuberculosis
SPDTMFAEQMKILV

SEQ ID NO: 198535 - protein, 14 aa, Mycobacterium tuberculosis
PDTMFAEQMKILVP

SEQ ID NO: 198536 - protein, 14 aa, Mycobacterium tuberculosis
DTMFAEQMKILVPV

SEQ ID NO: 198537 - protein, 14 aa, Mycobacterium tuberculosis
TMFAEQMKILVPVF

SEQ ID NO: 198538 - protein, 14 aa, Mycobacterium tuberculosis
MFAEQMKILVPVFT

SEQ ID NO: 198539 - protein, 14 aa, Mycobacterium tuberculosis
FAEQMKILVPVFTS

SEQ ID NO: 198540 - protein, 14 aa, Mycobacterium tuberculosis
AEQMKILVPVFTSN

SEQ ID NO: 198541 - protein, 14 aa, Mycobacterium tuberculosis
EQMKILVPVFTSND

SEQ ID NO: 198542 - protein, 14 aa, Mycobacterium tuberculosis
QMKILVPVFTSNDA

SEQ ID NO: 198543 - protein, 14 aa, Mycobacterium tuberculosis
MKILVPVFTSNDAK

SEQ ID NO: 198544 - protein, 14 aa, Mycobacterium tuberculosis
KILVPVFTSNDAKE

SEQ ID NO: 198545 - protein, 14 aa, Mycobacterium tuberculosis
ILVPVFTSNDAKEG

SEQ ID NO: 198546 - protein, 14 aa, Mycobacterium tuberculosis
LVPVFTSNDAKEGA

SEQ ID NO: 198547 - protein, 14 aa, Mycobacterium tuberculosis
VPVFTSNDAKEGAI

SEQ ID NO: 198548 - protein, 14 aa, Mycobacterium tuberculosis
PVFTSNDAKEGAIA

SEQ ID NO: 198549 - protein, 14 aa, Mycobacterium tuberculosis
VFTSNDAKEGAIAF

SEQ ID NO: 198550 - protein, 14 aa, Mycobacterium tuberculosis
FTSNDAKEGAIAFA

SEQ ID NO: 198551 - protein, 14 aa, Mycobacterium tuberculosis
TSNDAKEGAIAFAE

SEQ ID NO: 198552 - protein, 14 aa, Mycobacterium tuberculosis
SNDAKEGAIAFAER

SEQ ID NO: 198553 - protein, 14 aa, Mycobacterium tuberculosis
NDAKEGAIAFAERR

SEQ ID NO: 198554 - protein, 14 aa, Mycobacterium tuberculosis
DAKEGAIAFAERRR

SEQ ID NO: 198555 - protein, 14 aa, Mycobacterium tuberculosis
AKEGAIAFAERRRP

SEQ ID NO: 198556 - protein, 14 aa, Mycobacterium tuberculosis
KEGAIAFAERRRPR

SEQ ID NO: 198557 - protein, 14 aa, Mycobacterium tuberculosis
EGAIAFAERRRPRW

SEQ ID NO: 198558 - protein, 14 aa, Mycobacterium tuberculosis
GAIAFAERRRPRWT

SEQ ID NO: 198559 - protein, 14 aa, Mycobacterium tuberculosis
AIAFAERRRPRWTG

SEQ ID NO: 198560 - protein, 14 aa, Mycobacterium tuberculosis
IAFAERRRPRWTGT

SEQ ID NO: 198561 - protein, 15 aa, Mycobacterium tuberculosis
MSSESDAANTEPEVL

SEQ ID NO: 198562 - protein, 15 aa, Mycobacterium tuberculosis
SSESDAANTEPEVLV

SEQ ID NO: 198563 - protein, 15 aa, Mycobacterium tuberculosis
SESDAANTEPEVLVE

SEQ ID NO: 198564 - protein, 15 aa, Mycobacterium tuberculosis
ESDAANTEPEVLVEQ

SEQ ID NO: 198565 - protein, 15 aa, Mycobacterium tuberculosis
SDAANTEPEVLVEQR

SEQ ID NO: 198566 - protein, 15 aa, Mycobacterium tuberculosis
DAANTEPEVLVEQRD

SEQ ID NO: 198567 - protein, 15 aa, Mycobacterium tuberculosis
AANTEPEVLVEQRDR

SEQ ID NO: 198568 - protein, 15 aa, Mycobacterium tuberculosis
ANTEPEVLVEQRDRI

SEQ ID NO: 198569 - protein, 15 aa, Mycobacterium tuberculosis
NTEPEVLVEQRDRIL

SEQ ID NO: 198570 - protein, 15 aa, Mycobacterium tuberculosis
TEPEVLVEQRDRILI

SEQ ID NO: 198571 - protein, 15 aa, Mycobacterium tuberculosis
EPEVLVEQRDRILII

SEQ ID NO: 198572 - protein, 15 aa, Mycobacterium tuberculosis
PEVLVEQRDRILIIT

SEQ ID NO: 198573 - protein, 15 aa, Mycobacterium tuberculosis
EVLVEQRDRILIITI

SEQ ID NO: 198574 - protein, 15 aa, Mycobacterium tuberculosis
VLVEQRDRILIITIN

SEQ ID NO: 198575 - protein, 15 aa, Mycobacterium tuberculosis
LVEQRDRILIITINR

SEQ ID NO: 198576 - protein, 15 aa, Mycobacterium tuberculosis
VEQRDRILIITINRP

SEQ ID NO: 198577 - protein, 15 aa, Mycobacterium tuberculosis
EQRDRILIITINRPK

SEQ ID NO: 198578 - protein, 15 aa, Mycobacterium tuberculosis
QRDRILIITINRPKA

SEQ ID NO: 198579 - protein, 15 aa, Mycobacterium tuberculosis
RDRILIITINRPKAK

SEQ ID NO: 198580 - protein, 15 aa, Mycobacterium tuberculosis
DRILIITINRPKAKN

SEQ ID NO: 198581 - protein, 15 aa, Mycobacterium tuberculosis
RILIITINRPKAKNA

SEQ ID NO: 198582 - protein, 15 aa, Mycobacterium tuberculosis
ILIITINRPKAKNAV

SEQ ID NO: 198583 - protein, 15 aa, Mycobacterium tuberculosis
LIITINRPKAKNAVN

SEQ ID NO: 198584 - protein, 15 aa, Mycobacterium tuberculosis
IITINRPKAKNAVNA

SEQ ID NO: 198585 - protein, 15 aa, Mycobacterium tuberculosis
ITINRPKAKNAVNAA

SEQ ID NO: 198586 - protein, 15 aa, Mycobacterium tuberculosis
TINRPKAKNAVNAAV

SEQ ID NO: 198587 - protein, 15 aa, Mycobacterium tuberculosis
INRPKAKNAVNAAVS

SEQ ID NO: 198588 - protein, 15 aa, Mycobacterium tuberculosis
NRPKAKNAVNAAVSR

SEQ ID NO: 198589 - protein, 15 aa, Mycobacterium tuberculosis
RPKAKNAVNAAVSRG

SEQ ID NO: 198590 - protein, 15 aa, Mycobacterium tuberculosis
PKAKNAVNAAVSRGL

SEQ ID NO: 198591 - protein, 15 aa, Mycobacterium tuberculosis
KAKNAVNAAVSRGLA

SEQ ID NO: 198592 - protein, 15 aa, Mycobacterium tuberculosis
AKNAVNAAVSRGLAD

SEQ ID NO: 198593 - protein, 15 aa, Mycobacterium tuberculosis
KNAVNAAVSRGLADA

SEQ ID NO: 198594 - protein, 15 aa, Mycobacterium tuberculosis
NAVNAAVSRGLADAM

SEQ ID NO: 198595 - protein, 15 aa, Mycobacterium tuberculosis
AVNAAVSRGLADAMD

SEQ ID NO: 198596 - protein, 15 aa, Mycobacterium tuberculosis
VNAAVSRGLADAMDQ

SEQ ID NO: 198597 - protein, 15 aa, Mycobacterium tuberculosis
NAAVSRGLADAMDQL

SEQ ID NO: 198598 - protein, 15 aa, Mycobacterium tuberculosis
AAVSRGLADAMDQLD

SEQ ID NO: 198599 - protein, 15 aa, Mycobacterium tuberculosis
AVSRGLADAMDQLDG

SEQ ID NO: 198600 - protein, 15 aa, Mycobacterium tuberculosis
VSRGLADAMDQLDGD

SEQ ID NO: 198601 - protein, 15 aa, Mycobacterium tuberculosis
SRGLADAMDQLDGDA

SEQ ID NO: 198602 - protein, 15 aa, Mycobacterium tuberculosis
RGLADAMDQLDGDAG

SEQ ID NO: 198603 - protein, 15 aa, Mycobacterium tuberculosis
GLADAMDQLDGDAGL

SEQ ID NO: 198604 - protein, 15 aa, Mycobacterium tuberculosis
LADAMDQLDGDAGLS

SEQ ID NO: 198605 - protein, 15 aa, Mycobacterium tuberculosis
ADAMDQLDGDAGLSV

SEQ ID NO: 198606 - protein, 15 aa, Mycobacterium tuberculosis
DAMDQLDGDAGLSVA

SEQ ID NO: 198607 - protein, 15 aa, Mycobacterium tuberculosis
AMDQLDGDAGLSVAI

SEQ ID NO: 198608 - protein, 15 aa, Mycobacterium tuberculosis
MDQLDGDAGLSVAIL

SEQ ID NO: 198609 - protein, 15 aa, Mycobacterium tuberculosis
DQLDGDAGLSVAILT

SEQ ID NO: 198610 - protein, 15 aa, Mycobacterium tuberculosis
QLDGDAGLSVAILTG

SEQ ID NO: 198611 - protein, 15 aa, Mycobacterium tuberculosis
LDGDAGLSVAILTGG

SEQ ID NO: 198612 - protein, 15 aa, Mycobacterium tuberculosis
DGDAGLSVAILTGGG

SEQ ID NO: 198613 - protein, 15 aa, Mycobacterium tuberculosis
GDAGLSVAILTGGGG

SEQ ID NO: 198614 - protein, 15 aa, Mycobacterium tuberculosis
DAGLSVAILTGGGGS

SEQ ID NO: 198615 - protein, 15 aa, Mycobacterium tuberculosis
AGLSVAILTGGGGSF

SEQ ID NO: 198616 - protein, 15 aa, Mycobacterium tuberculosis
GLSVAILTGGGGSFC

SEQ ID NO: 198617 - protein, 15 aa, Mycobacterium tuberculosis
LSVAILTGGGGSFCA

SEQ ID NO: 198618 - protein, 15 aa, Mycobacterium tuberculosis
SVAILTGGGGSFCAG

SEQ ID NO: 198619 - protein, 15 aa, Mycobacterium tuberculosis
VAILTGGGGSFCAGM

SEQ ID NO: 198620 - protein, 15 aa, Mycobacterium tuberculosis
AILTGGGGSFCAGMD

SEQ ID NO: 198621 - protein, 15 aa, Mycobacterium tuberculosis
ILTGGGGSFCAGMDL

SEQ ID NO: 198622 - protein, 15 aa, Mycobacterium tuberculosis
LTGGGGSFCAGMDLK

SEQ ID NO: 198623 - protein, 15 aa, Mycobacterium tuberculosis
TGGGGSFCAGMDLKA

SEQ ID NO: 198624 - protein, 15 aa, Mycobacterium tuberculosis
GGGGSFCAGMDLKAF

SEQ ID NO: 198625 - protein, 15 aa, Mycobacterium tuberculosis
GGGSFCAGMDLKAFA

SEQ ID NO: 198626 - protein, 15 aa, Mycobacterium tuberculosis
GGSFCAGMDLKAFAR

SEQ ID NO: 198627 - protein, 15 aa, Mycobacterium tuberculosis
GSFCAGMDLKAFARG

SEQ ID NO: 198628 - protein, 15 aa, Mycobacterium tuberculosis
SFCAGMDLKAFARGE

SEQ ID NO: 198629 - protein, 15 aa, Mycobacterium tuberculosis
FCAGMDLKAFARGEN

SEQ ID NO: 198630 - protein, 15 aa, Mycobacterium tuberculosis
CAGMDLKAFARGENV

SEQ ID NO: 198631 - protein, 15 aa, Mycobacterium tuberculosis
AGMDLKAFARGENVV

SEQ ID NO: 198632 - protein, 15 aa, Mycobacterium tuberculosis
GMDLKAFARGENVVV

SEQ ID NO: 198633 - protein, 15 aa, Mycobacterium tuberculosis
MDLKAFARGENVVVE

SEQ ID NO: 198634 - protein, 15 aa, Mycobacterium tuberculosis
DLKAFARGENVVVEG

SEQ ID NO: 198635 - protein, 15 aa, Mycobacterium tuberculosis
LKAFARGENVVVEGR

SEQ ID NO: 198636 - protein, 15 aa, Mycobacterium tuberculosis
KAFARGENVVVEGRG

SEQ ID NO: 198637 - protein, 15 aa, Mycobacterium tuberculosis
AFARGENVVVEGRGL

SEQ ID NO: 198638 - protein, 15 aa, Mycobacterium tuberculosis
FARGENVVVEGRGLG

SEQ ID NO: 198639 - protein, 15 aa, Mycobacterium tuberculosis
ARGENVVVEGRGLGF

SEQ ID NO: 198640 - protein, 15 aa, Mycobacterium tuberculosis
RGENVVVEGRGLGFT

SEQ ID NO: 198641 - protein, 15 aa, Mycobacterium tuberculosis
GENVVVEGRGLGFTE

SEQ ID NO: 198642 - protein, 15 aa, Mycobacterium tuberculosis
ENVVVEGRGLGFTER

SEQ ID NO: 198643 - protein, 15 aa, Mycobacterium tuberculosis
NVVVEGRGLGFTERP

SEQ ID NO: 198644 - protein, 15 aa, Mycobacterium tuberculosis
VVVEGRGLGFTERPP

SEQ ID NO: 198645 - protein, 15 aa, Mycobacterium tuberculosis
VVEGRGLGFTERPPT

SEQ ID NO: 198646 - protein, 15 aa, Mycobacterium tuberculosis
VEGRGLGFTERPPTK

SEQ ID NO: 198647 - protein, 15 aa, Mycobacterium tuberculosis
EGRGLGFTERPPTKP

SEQ ID NO: 198648 - protein, 15 aa, Mycobacterium tuberculosis
GRGLGFTERPPTKPL

SEQ ID NO: 198649 - protein, 15 aa, Mycobacterium tuberculosis
RGLGFTERPPTKPLI

SEQ ID NO: 198650 - protein, 15 aa, Mycobacterium tuberculosis
GLGFTERPPTKPLIA

SEQ ID NO: 198651 - protein, 15 aa, Mycobacterium tuberculosis
LGFTERPPTKPLIAA

SEQ ID NO: 198652 - protein, 15 aa, Mycobacterium tuberculosis
GFTERPPTKPLIAAV

SEQ ID NO: 198653 - protein, 15 aa, Mycobacterium tuberculosis
FTERPPTKPLIAAVE

SEQ ID NO: 198654 - protein, 15 aa, Mycobacterium tuberculosis
TERPPTKPLIAAVEG

SEQ ID NO: 198655 - protein, 15 aa, Mycobacterium tuberculosis
ERPPTKPLIAAVEGY

SEQ ID NO: 198656 - protein, 15 aa, Mycobacterium tuberculosis
RPPTKPLIAAVEGYA

SEQ ID NO: 198657 - protein, 15 aa, Mycobacterium tuberculosis
PPTKPLIAAVEGYAL

SEQ ID NO: 198658 - protein, 15 aa, Mycobacterium tuberculosis
PTKPLIAAVEGYALA

SEQ ID NO: 198659 - protein, 15 aa, Mycobacterium tuberculosis
TKPLIAAVEGYALAG

SEQ ID NO: 198660 - protein, 15 aa, Mycobacterium tuberculosis
KPLIAAVEGYALAGG

SEQ ID NO: 198661 - protein, 15 aa, Mycobacterium tuberculosis
PLIAAVEGYALAGGT

SEQ ID NO: 198662 - protein, 15 aa, Mycobacterium tuberculosis
LIAAVEGYALAGGTE

SEQ ID NO: 198663 - protein, 15 aa, Mycobacterium tuberculosis
IAAVEGYALAGGTEL

SEQ ID NO: 198664 - protein, 15 aa, Mycobacterium tuberculosis
AAVEGYALAGGTELA

SEQ ID NO: 198665 - protein, 15 aa, Mycobacterium tuberculosis
AVEGYALAGGTELAL

SEQ ID NO: 198666 - protein, 15 aa, Mycobacterium tuberculosis
VEGYALAGGTELALA

SEQ ID NO: 198667 - protein, 15 aa, Mycobacterium tuberculosis
EGYALAGGTELALAA

SEQ ID NO: 198668 - protein, 15 aa, Mycobacterium tuberculosis
GYALAGGTELALAAD

SEQ ID NO: 198669 - protein, 15 aa, Mycobacterium tuberculosis
YALAGGTELALAADL

SEQ ID NO: 198670 - protein, 15 aa, Mycobacterium tuberculosis
ALAGGTELALAADLI

SEQ ID NO: 198671 - protein, 15 aa, Mycobacterium tuberculosis
LAGGTELALAADLIV

SEQ ID NO: 198672 - protein, 15 aa, Mycobacterium tuberculosis
AGGTELALAADLIVA

SEQ ID NO: 198673 - protein, 15 aa, Mycobacterium tuberculosis
GGTELALAADLIVAA

SEQ ID NO: 198674 - protein, 15 aa, Mycobacterium tuberculosis
GTELALAADLIVAAR

SEQ ID NO: 198675 - protein, 15 aa, Mycobacterium tuberculosis
TELALAADLIVAARD

SEQ ID NO: 198676 - protein, 15 aa, Mycobacterium tuberculosis
ELALAADLIVAARDS

SEQ ID NO: 198677 - protein, 15 aa, Mycobacterium tuberculosis
LALAADLIVAARDSA

SEQ ID NO: 198678 - protein, 15 aa, Mycobacterium tuberculosis
ALAADLIVAARDSAF

SEQ ID NO: 198679 - protein, 15 aa, Mycobacterium tuberculosis
LAADLIVAARDSAFG

SEQ ID NO: 198680 - protein, 15 aa, Mycobacterium tuberculosis
AADLIVAARDSAFGI

SEQ ID NO: 198681 - protein, 15 aa, Mycobacterium tuberculosis
ADLIVAARDSAFGIP

SEQ ID NO: 198682 - protein, 15 aa, Mycobacterium tuberculosis
DLIVAARDSAFGIPE

SEQ ID NO: 198683 - protein, 15 aa, Mycobacterium tuberculosis
LIVAARDSAFGIPEV

SEQ ID NO: 198684 - protein, 15 aa, Mycobacterium tuberculosis
IVAARDSAFGIPEVK

SEQ ID NO: 198685 - protein, 15 aa, Mycobacterium tuberculosis
VAARDSAFGIPEVKR

SEQ ID NO: 198686 - protein, 15 aa, Mycobacterium tuberculosis
AARDSAFGIPEVKRG

SEQ ID NO: 198687 - protein, 15 aa, Mycobacterium tuberculosis
ARDSAFGIPEVKRGL

SEQ ID NO: 198688 - protein, 15 aa, Mycobacterium tuberculosis
RDSAFGIPEVKRGLV

SEQ ID NO: 198689 - protein, 15 aa, Mycobacterium tuberculosis
DSAFGIPEVKRGLVA

SEQ ID NO: 198690 - protein, 15 aa, Mycobacterium tuberculosis
SAFGIPEVKRGLVAG

SEQ ID NO: 198691 - protein, 15 aa, Mycobacterium tuberculosis
AFGIPEVKRGLVAGG

SEQ ID NO: 198692 - protein, 15 aa, Mycobacterium tuberculosis
FGIPEVKRGLVAGGG

SEQ ID NO: 198693 - protein, 15 aa, Mycobacterium tuberculosis
GIPEVKRGLVAGGGG

SEQ ID NO: 198694 - protein, 15 aa, Mycobacterium tuberculosis
IPEVKRGLVAGGGGL

SEQ ID NO: 198695 - protein, 15 aa, Mycobacterium tuberculosis
PEVKRGLVAGGGGLL

SEQ ID NO: 198696 - protein, 15 aa, Mycobacterium tuberculosis
EVKRGLVAGGGGLLR

SEQ ID NO: 198697 - protein, 15 aa, Mycobacterium tuberculosis
VKRGLVAGGGGLLRL

SEQ ID NO: 198698 - protein, 15 aa, Mycobacterium tuberculosis
KRGLVAGGGGLLRLP

SEQ ID NO: 198699 - protein, 15 aa, Mycobacterium tuberculosis
RGLVAGGGGLLRLPE

SEQ ID NO: 198700 - protein, 15 aa, Mycobacterium tuberculosis
GLVAGGGGLLRLPER

SEQ ID NO: 198701 - protein, 15 aa, Mycobacterium tuberculosis
LVAGGGGLLRLPERI

SEQ ID NO: 198702 - protein, 15 aa, Mycobacterium tuberculosis
VAGGGGLLRLPERIP

SEQ ID NO: 198703 - protein, 15 aa, Mycobacterium tuberculosis
AGGGGLLRLPERIPY

SEQ ID NO: 198704 - protein, 15 aa, Mycobacterium tuberculosis
GGGGLLRLPERIPYA

SEQ ID NO: 198705 - protein, 15 aa, Mycobacterium tuberculosis
GGGLLRLPERIPYAI

SEQ ID NO: 198706 - protein, 15 aa, Mycobacterium tuberculosis
GGLLRLPERIPYAIA

SEQ ID NO: 198707 - protein, 15 aa, Mycobacterium tuberculosis
GLLRLPERIPYAIAM

SEQ ID NO: 198708 - protein, 15 aa, Mycobacterium tuberculosis
LLRLPERIPYAIAME

SEQ ID NO: 198709 - protein, 15 aa, Mycobacterium tuberculosis
LRLPERIPYAIAMEL

SEQ ID NO: 198710 - protein, 15 aa, Mycobacterium tuberculosis
RLPERIPYAIAMELA

SEQ ID NO: 198711 - protein, 15 aa, Mycobacterium tuberculosis
LPERIPYAIAMELAL

SEQ ID NO: 198712 - protein, 15 aa, Mycobacterium tuberculosis
PERIPYAIAMELALT

SEQ ID NO: 198713 - protein, 15 aa, Mycobacterium tuberculosis
ERIPYAIAMELALTG

SEQ ID NO: 198714 - protein, 15 aa, Mycobacterium tuberculosis
RIPYAIAMELALTGD

SEQ ID NO: 198715 - protein, 15 aa, Mycobacterium tuberculosis
IPYAIAMELALTGDN

SEQ ID NO: 198716 - protein, 15 aa, Mycobacterium tuberculosis
PYAIAMELALTGDNL

SEQ ID NO: 198717 - protein, 15 aa, Mycobacterium tuberculosis
YAIAMELALTGDNLP

SEQ ID NO: 198718 - protein, 15 aa, Mycobacterium tuberculosis
AIAMELALTGDNLPA

SEQ ID NO: 198719 - protein, 15 aa, Mycobacterium tuberculosis
IAMELALTGDNLPAE

SEQ ID NO: 198720 - protein, 15 aa, Mycobacterium tuberculosis
AMELALTGDNLPAER

SEQ ID NO: 198721 - protein, 15 aa, Mycobacterium tuberculosis
MELALTGDNLPAERA

SEQ ID NO: 198722 - protein, 15 aa, Mycobacterium tuberculosis
ELALTGDNLPAERAH

SEQ ID NO: 198723 - protein, 15 aa, Mycobacterium tuberculosis
LALTGDNLPAERAHE

SEQ ID NO: 198724 - protein, 15 aa, Mycobacterium tuberculosis
ALTGDNLPAERAHEL

SEQ ID NO: 198725 - protein, 15 aa, Mycobacterium tuberculosis
LTGDNLPAERAHELG

SEQ ID NO: 198726 - protein, 15 aa, Mycobacterium tuberculosis
TGDNLPAERAHELGL

SEQ ID NO: 198727 - protein, 15 aa, Mycobacterium tuberculosis
GDNLPAERAHELGLV

SEQ ID NO: 198728 - protein, 15 aa, Mycobacterium tuberculosis
DNLPAERAHELGLVN

SEQ ID NO: 198729 - protein, 15 aa, Mycobacterium tuberculosis
NLPAERAHELGLVNV

SEQ ID NO: 198730 - protein, 15 aa, Mycobacterium tuberculosis
LPAERAHELGLVNVL

SEQ ID NO: 198731 - protein, 15 aa, Mycobacterium tuberculosis
PAERAHELGLVNVLA

SEQ ID NO: 198732 - protein, 15 aa, Mycobacterium tuberculosis
AERAHELGLVNVLAE

SEQ ID NO: 198733 - protein, 15 aa, Mycobacterium tuberculosis
ERAHELGLVNVLAEP

SEQ ID NO: 198734 - protein, 15 aa, Mycobacterium tuberculosis
RAHELGLVNVLAEPG

SEQ ID NO: 198735 - protein, 15 aa, Mycobacterium tuberculosis
AHELGLVNVLAEPGT

SEQ ID NO: 198736 - protein, 15 aa, Mycobacterium tuberculosis
HELGLVNVLAEPGTA

SEQ ID NO: 198737 - protein, 15 aa, Mycobacterium tuberculosis
ELGLVNVLAEPGTAL

SEQ ID NO: 198738 - protein, 15 aa, Mycobacterium tuberculosis
LGLVNVLAEPGTALD

SEQ ID NO: 198739 - protein, 15 aa, Mycobacterium tuberculosis
GLVNVLAEPGTALDA

SEQ ID NO: 198740 - protein, 15 aa, Mycobacterium tuberculosis
LVNVLAEPGTALDAA

SEQ ID NO: 198741 - protein, 15 aa, Mycobacterium tuberculosis
VNVLAEPGTALDAAI

SEQ ID NO: 198742 - protein, 15 aa, Mycobacterium tuberculosis
NVLAEPGTALDAAIA

SEQ ID NO: 198743 - protein, 15 aa, Mycobacterium tuberculosis
VLAEPGTALDAAIAL

SEQ ID NO: 198744 - protein, 15 aa, Mycobacterium tuberculosis
LAEPGTALDAAIALA

SEQ ID NO: 198745 - protein, 15 aa, Mycobacterium tuberculosis
AEPGTALDAAIALAE

SEQ ID NO: 198746 - protein, 15 aa, Mycobacterium tuberculosis
EPGTALDAAIALAEK

SEQ ID NO: 198747 - protein, 15 aa, Mycobacterium tuberculosis
PGTALDAAIALAEKI

SEQ ID NO: 198748 - protein, 15 aa, Mycobacterium tuberculosis
GTALDAAIALAEKIT

SEQ ID NO: 198749 - protein, 15 aa, Mycobacterium tuberculosis
TALDAAIALAEKITA

SEQ ID NO: 198750 - protein, 15 aa, Mycobacterium tuberculosis
ALDAAIALAEKITAN

SEQ ID NO: 198751 - protein, 15 aa, Mycobacterium tuberculosis
LDAAIALAEKITANG

SEQ ID NO: 198752 - protein, 15 aa, Mycobacterium tuberculosis
DAAIALAEKITANGP

SEQ ID NO: 198753 - protein, 15 aa, Mycobacterium tuberculosis
AAIALAEKITANGPL

SEQ ID NO: 198754 - protein, 15 aa, Mycobacterium tuberculosis
AIALAEKITANGPLA

SEQ ID NO: 198755 - protein, 15 aa, Mycobacterium tuberculosis
IALAEKITANGPLAV

SEQ ID NO: 198756 - protein, 15 aa, Mycobacterium tuberculosis
ALAEKITANGPLAVV

SEQ ID NO: 198757 - protein, 15 aa, Mycobacterium tuberculosis
LAEKITANGPLAVVA

SEQ ID NO: 198758 - protein, 15 aa, Mycobacterium tuberculosis
AEKITANGPLAVVAT

SEQ ID NO: 198759 - protein, 15 aa, Mycobacterium tuberculosis
EKITANGPLAVVATK

SEQ ID NO: 198760 - protein, 15 aa, Mycobacterium tuberculosis
KITANGPLAVVATKR

SEQ ID NO: 198761 - protein, 15 aa, Mycobacterium tuberculosis
ITANGPLAVVATKRI

SEQ ID NO: 198762 - protein, 15 aa, Mycobacterium tuberculosis
TANGPLAVVATKRII

SEQ ID NO: 198763 - protein, 15 aa, Mycobacterium tuberculosis
ANGPLAVVATKRIIT

SEQ ID NO: 198764 - protein, 15 aa, Mycobacterium tuberculosis
NGPLAVVATKRIITE

SEQ ID NO: 198765 - protein, 15 aa, Mycobacterium tuberculosis
GPLAVVATKRIITES

SEQ ID NO: 198766 - protein, 15 aa, Mycobacterium tuberculosis
PLAVVATKRIITESR

SEQ ID NO: 198767 - protein, 15 aa, Mycobacterium tuberculosis
LAVVATKRIITESRG

SEQ ID NO: 198768 - protein, 15 aa, Mycobacterium tuberculosis
AVVATKRIITESRGW

SEQ ID NO: 198769 - protein, 15 aa, Mycobacterium tuberculosis
VVATKRIITESRGWS

SEQ ID NO: 198770 - protein, 15 aa, Mycobacterium tuberculosis
VATKRIITESRGWSP

SEQ ID NO: 198771 - protein, 15 aa, Mycobacterium tuberculosis
ATKRIITESRGWSPD

SEQ ID NO: 198772 - protein, 15 aa, Mycobacterium tuberculosis
TKRIITESRGWSPDT

SEQ ID NO: 198773 - protein, 15 aa, Mycobacterium tuberculosis
KRIITESRGWSPDTM

SEQ ID NO: 198774 - protein, 15 aa, Mycobacterium tuberculosis
RIITESRGWSPDTMF

SEQ ID NO: 198775 - protein, 15 aa, Mycobacterium tuberculosis
IITESRGWSPDTMFA

SEQ ID NO: 198776 - protein, 15 aa, Mycobacterium tuberculosis
ITESRGWSPDTMFAE

SEQ ID NO: 198777 - protein, 15 aa, Mycobacterium tuberculosis
TESRGWSPDTMFAEQ

SEQ ID NO: 198778 - protein, 15 aa, Mycobacterium tuberculosis
ESRGWSPDTMFAEQM

SEQ ID NO: 198779 - protein, 15 aa, Mycobacterium tuberculosis
SRGWSPDTMFAEQMK

SEQ ID NO: 198780 - protein, 15 aa, Mycobacterium tuberculosis
RGWSPDTMFAEQMKI

SEQ ID NO: 198781 - protein, 15 aa, Mycobacterium tuberculosis
GWSPDTMFAEQMKIL

SEQ ID NO: 198782 - protein, 15 aa, Mycobacterium tuberculosis
WSPDTMFAEQMKILV

SEQ ID NO: 198783 - protein, 15 aa, Mycobacterium tuberculosis
SPDTMFAEQMKILVP

SEQ ID NO: 198784 - protein, 15 aa, Mycobacterium tuberculosis
PDTMFAEQMKILVPV

SEQ ID NO: 198785 - protein, 15 aa, Mycobacterium tuberculosis
DTMFAEQMKILVPVF

SEQ ID NO: 198786 - protein, 15 aa, Mycobacterium tuberculosis
TMFAEQMKILVPVFT

SEQ ID NO: 198787 - protein, 15 aa, Mycobacterium tuberculosis
MFAEQMKILVPVFTS

SEQ ID NO: 198788 - protein, 15 aa, Mycobacterium tuberculosis
FAEQMKILVPVFTSN

SEQ ID NO: 198789 - protein, 15 aa, Mycobacterium tuberculosis
AEQMKILVPVFTSND

SEQ ID NO: 198790 - protein, 15 aa, Mycobacterium tuberculosis
EQMKILVPVFTSNDA

SEQ ID NO: 198791 - protein, 15 aa, Mycobacterium tuberculosis
QMKILVPVFTSNDAK

SEQ ID NO: 198792 - protein, 15 aa, Mycobacterium tuberculosis
MKILVPVFTSNDAKE

SEQ ID NO: 198793 - protein, 15 aa, Mycobacterium tuberculosis
KILVPVFTSNDAKEG

SEQ ID NO: 198794 - protein, 15 aa, Mycobacterium tuberculosis
ILVPVFTSNDAKEGA

SEQ ID NO: 198795 - protein, 15 aa, Mycobacterium tuberculosis
LVPVFTSNDAKEGAI

SEQ ID NO: 198796 - protein, 15 aa, Mycobacterium tuberculosis
VPVFTSNDAKEGAIA

SEQ ID NO: 198797 - protein, 15 aa, Mycobacterium tuberculosis
PVFTSNDAKEGAIAF

SEQ ID NO: 198798 - protein, 15 aa, Mycobacterium tuberculosis
VFTSNDAKEGAIAFA

SEQ ID NO: 198799 - protein, 15 aa, Mycobacterium tuberculosis
FTSNDAKEGAIAFAE

SEQ ID NO: 198800 - protein, 15 aa, Mycobacterium tuberculosis
TSNDAKEGAIAFAER

SEQ ID NO: 198801 - protein, 15 aa, Mycobacterium tuberculosis
SNDAKEGAIAFAERR

SEQ ID NO: 198802 - protein, 15 aa, Mycobacterium tuberculosis
NDAKEGAIAFAERRR

SEQ ID NO: 198803 - protein, 15 aa, Mycobacterium tuberculosis
DAKEGAIAFAERRRP

SEQ ID NO: 198804 - protein, 15 aa, Mycobacterium tuberculosis
AKEGAIAFAERRRPR

SEQ ID NO: 198805 - protein, 15 aa, Mycobacterium tuberculosis
KEGAIAFAERRRPRW

SEQ ID NO: 198806 - protein, 15 aa, Mycobacterium tuberculosis
EGAIAFAERRRPRWT

SEQ ID NO: 198807 - protein, 15 aa, Mycobacterium tuberculosis
GAIAFAERRRPRWTG

SEQ ID NO: 198808 - protein, 15 aa, Mycobacterium tuberculosis
AIAFAERRRPRWTGT

SEQ ID NO: 198809 - protein, 16 aa, Mycobacterium tuberculosis
MSSESDAANTEPEVLV

SEQ ID NO: 198810 - protein, 16 aa, Mycobacterium tuberculosis
SSESDAANTEPEVLVE

SEQ ID NO: 198811 - protein, 16 aa, Mycobacterium tuberculosis
SESDAANTEPEVLVEQ

SEQ ID NO: 198812 - protein, 16 aa, Mycobacterium tuberculosis
ESDAANTEPEVLVEQR

SEQ ID NO: 198813 - protein, 16 aa, Mycobacterium tuberculosis
SDAANTEPEVLVEQRD

SEQ ID NO: 198814 - protein, 16 aa, Mycobacterium tuberculosis
DAANTEPEVLVEQRDR

SEQ ID NO: 198815 - protein, 16 aa, Mycobacterium tuberculosis
AANTEPEVLVEQRDRI

SEQ ID NO: 198816 - protein, 16 aa, Mycobacterium tuberculosis
ANTEPEVLVEQRDRIL

SEQ ID NO: 198817 - protein, 16 aa, Mycobacterium tuberculosis
NTEPEVLVEQRDRILI

SEQ ID NO: 198818 - protein, 16 aa, Mycobacterium tuberculosis
TEPEVLVEQRDRILII

SEQ ID NO: 198819 - protein, 16 aa, Mycobacterium tuberculosis
EPEVLVEQRDRILIIT

SEQ ID NO: 198820 - protein, 16 aa, Mycobacterium tuberculosis
PEVLVEQRDRILIITI

SEQ ID NO: 198821 - protein, 16 aa, Mycobacterium tuberculosis
EVLVEQRDRILIITIN

SEQ ID NO: 198822 - protein, 16 aa, Mycobacterium tuberculosis
VLVEQRDRILIITINR

SEQ ID NO: 198823 - protein, 16 aa, Mycobacterium tuberculosis
LVEQRDRILIITINRP

SEQ ID NO: 198824 - protein, 16 aa, Mycobacterium tuberculosis
VEQRDRILIITINRPK

SEQ ID NO: 198825 - protein, 16 aa, Mycobacterium tuberculosis
EQRDRILIITINRPKA

SEQ ID NO: 198826 - protein, 16 aa, Mycobacterium tuberculosis
QRDRILIITINRPKAK

SEQ ID NO: 198827 - protein, 16 aa, Mycobacterium tuberculosis
RDRILIITINRPKAKN

SEQ ID NO: 198828 - protein, 16 aa, Mycobacterium tuberculosis
DRILIITINRPKAKNA

SEQ ID NO: 198829 - protein, 16 aa, Mycobacterium tuberculosis
RILIITINRPKAKNAV

SEQ ID NO: 198830 - protein, 16 aa, Mycobacterium tuberculosis
ILIITINRPKAKNAVN

SEQ ID NO: 198831 - protein, 16 aa, Mycobacterium tuberculosis
LIITINRPKAKNAVNA

SEQ ID NO: 198832 - protein, 16 aa, Mycobacterium tuberculosis
IITINRPKAKNAVNAA

SEQ ID NO: 198833 - protein, 16 aa, Mycobacterium tuberculosis
ITINRPKAKNAVNAAV

SEQ ID NO: 198834 - protein, 16 aa, Mycobacterium tuberculosis
TINRPKAKNAVNAAVS

SEQ ID NO: 198835 - protein, 16 aa, Mycobacterium tuberculosis
INRPKAKNAVNAAVSR

SEQ ID NO: 198836 - protein, 16 aa, Mycobacterium tuberculosis
NRPKAKNAVNAAVSRG

SEQ ID NO: 198837 - protein, 16 aa, Mycobacterium tuberculosis
RPKAKNAVNAAVSRGL

SEQ ID NO: 198838 - protein, 16 aa, Mycobacterium tuberculosis
PKAKNAVNAAVSRGLA

SEQ ID NO: 198839 - protein, 16 aa, Mycobacterium tuberculosis
KAKNAVNAAVSRGLAD

SEQ ID NO: 198840 - protein, 16 aa, Mycobacterium tuberculosis
AKNAVNAAVSRGLADA

SEQ ID NO: 198841 - protein, 16 aa, Mycobacterium tuberculosis
KNAVNAAVSRGLADAM

SEQ ID NO: 198842 - protein, 16 aa, Mycobacterium tuberculosis
NAVNAAVSRGLADAMD

SEQ ID NO: 198843 - protein, 16 aa, Mycobacterium tuberculosis
AVNAAVSRGLADAMDQ

SEQ ID NO: 198844 - protein, 16 aa, Mycobacterium tuberculosis
VNAAVSRGLADAMDQL

SEQ ID NO: 198845 - protein, 16 aa, Mycobacterium tuberculosis
NAAVSRGLADAMDQLD

SEQ ID NO: 198846 - protein, 16 aa, Mycobacterium tuberculosis
AAVSRGLADAMDQLDG

SEQ ID NO: 198847 - protein, 16 aa, Mycobacterium tuberculosis
AVSRGLADAMDQLDGD

SEQ ID NO: 198848 - protein, 16 aa, Mycobacterium tuberculosis
VSRGLADAMDQLDGDA

SEQ ID NO: 198849 - protein, 16 aa, Mycobacterium tuberculosis
SRGLADAMDQLDGDAG

SEQ ID NO: 198850 - protein, 16 aa, Mycobacterium tuberculosis
RGLADAMDQLDGDAGL

SEQ ID NO: 198851 - protein, 16 aa, Mycobacterium tuberculosis
GLADAMDQLDGDAGLS

SEQ ID NO: 198852 - protein, 16 aa, Mycobacterium tuberculosis
LADAMDQLDGDAGLSV

SEQ ID NO: 198853 - protein, 16 aa, Mycobacterium tuberculosis
ADAMDQLDGDAGLSVA

SEQ ID NO: 198854 - protein, 16 aa, Mycobacterium tuberculosis
DAMDQLDGDAGLSVAI

SEQ ID NO: 198855 - protein, 16 aa, Mycobacterium tuberculosis
AMDQLDGDAGLSVAIL

SEQ ID NO: 198856 - protein, 16 aa, Mycobacterium tuberculosis
MDQLDGDAGLSVAILT

SEQ ID NO: 198857 - protein, 16 aa, Mycobacterium tuberculosis
DQLDGDAGLSVAILTG

SEQ ID NO: 198858 - protein, 16 aa, Mycobacterium tuberculosis
QLDGDAGLSVAILTGG

SEQ ID NO: 198859 - protein, 16 aa, Mycobacterium tuberculosis
LDGDAGLSVAILTGGG

SEQ ID NO: 198860 - protein, 16 aa, Mycobacterium tuberculosis
DGDAGLSVAILTGGGG

SEQ ID NO: 198861 - protein, 16 aa, Mycobacterium tuberculosis
GDAGLSVAILTGGGGS

SEQ ID NO: 198862 - protein, 16 aa, Mycobacterium tuberculosis
DAGLSVAILTGGGGSF

SEQ ID NO: 198863 - protein, 16 aa, Mycobacterium tuberculosis
AGLSVAILTGGGGSFC

SEQ ID NO: 198864 - protein, 16 aa, Mycobacterium tuberculosis
GLSVAILTGGGGSFCA

SEQ ID NO: 198865 - protein, 16 aa, Mycobacterium tuberculosis
LSVAILTGGGGSFCAG

SEQ ID NO: 198866 - protein, 16 aa, Mycobacterium tuberculosis
SVAILTGGGGSFCAGM

SEQ ID NO: 198867 - protein, 16 aa, Mycobacterium tuberculosis
VAILTGGGGSFCAGMD

SEQ ID NO: 198868 - protein, 16 aa, Mycobacterium tuberculosis
AILTGGGGSFCAGMDL

SEQ ID NO: 198869 - protein, 16 aa, Mycobacterium tuberculosis
ILTGGGGSFCAGMDLK

SEQ ID NO: 198870 - protein, 16 aa, Mycobacterium tuberculosis
LTGGGGSFCAGMDLKA

SEQ ID NO: 198871 - protein, 16 aa, Mycobacterium tuberculosis
TGGGGSFCAGMDLKAF

SEQ ID NO: 198872 - protein, 16 aa, Mycobacterium tuberculosis
GGGGSFCAGMDLKAFA

SEQ ID NO: 198873 - protein, 16 aa, Mycobacterium tuberculosis
GGGSFCAGMDLKAFAR

SEQ ID NO: 198874 - protein, 16 aa, Mycobacterium tuberculosis
GGSFCAGMDLKAFARG

SEQ ID NO: 198875 - protein, 16 aa, Mycobacterium tuberculosis
GSFCAGMDLKAFARGE

SEQ ID NO: 198876 - protein, 16 aa, Mycobacterium tuberculosis
SFCAGMDLKAFARGEN

SEQ ID NO: 198877 - protein, 16 aa, Mycobacterium tuberculosis
FCAGMDLKAFARGENV

SEQ ID NO: 198878 - protein, 16 aa, Mycobacterium tuberculosis
CAGMDLKAFARGENVV

SEQ ID NO: 198879 - protein, 16 aa, Mycobacterium tuberculosis
AGMDLKAFARGENVVV

SEQ ID NO: 198880 - protein, 16 aa, Mycobacterium tuberculosis
GMDLKAFARGENVVVE

SEQ ID NO: 198881 - protein, 16 aa, Mycobacterium tuberculosis
MDLKAFARGENVVVEG

SEQ ID NO: 198882 - protein, 16 aa, Mycobacterium tuberculosis
DLKAFARGENVVVEGR

SEQ ID NO: 198883 - protein, 16 aa, Mycobacterium tuberculosis
LKAFARGENVVVEGRG

SEQ ID NO: 198884 - protein, 16 aa, Mycobacterium tuberculosis
KAFARGENVVVEGRGL

SEQ ID NO: 198885 - protein, 16 aa, Mycobacterium tuberculosis
AFARGENVVVEGRGLG

SEQ ID NO: 198886 - protein, 16 aa, Mycobacterium tuberculosis
FARGENVVVEGRGLGF

SEQ ID NO: 198887 - protein, 16 aa, Mycobacterium tuberculosis
ARGENVVVEGRGLGFT

SEQ ID NO: 198888 - protein, 16 aa, Mycobacterium tuberculosis
RGENVVVEGRGLGFTE

SEQ ID NO: 198889 - protein, 16 aa, Mycobacterium tuberculosis
GENVVVEGRGLGFTER

SEQ ID NO: 198890 - protein, 16 aa, Mycobacterium tuberculosis
ENVVVEGRGLGFTERP

SEQ ID NO: 198891 - protein, 16 aa, Mycobacterium tuberculosis
NVVVEGRGLGFTERPP

SEQ ID NO: 198892 - protein, 16 aa, Mycobacterium tuberculosis
VVVEGRGLGFTERPPT

SEQ ID NO: 198893 - protein, 16 aa, Mycobacterium tuberculosis
VVEGRGLGFTERPPTK

SEQ ID NO: 198894 - protein, 16 aa, Mycobacterium tuberculosis
VEGRGLGFTERPPTKP

SEQ ID NO: 198895 - protein, 16 aa, Mycobacterium tuberculosis
EGRGLGFTERPPTKPL

SEQ ID NO: 198896 - protein, 16 aa, Mycobacterium tuberculosis
GRGLGFTERPPTKPLI

SEQ ID NO: 198897 - protein, 16 aa, Mycobacterium tuberculosis
RGLGFTERPPTKPLIA

SEQ ID NO: 198898 - protein, 16 aa, Mycobacterium tuberculosis
GLGFTERPPTKPLIAA

SEQ ID NO: 198899 - protein, 16 aa, Mycobacterium tuberculosis
LGFTERPPTKPLIAAV

SEQ ID NO: 198900 - protein, 16 aa, Mycobacterium tuberculosis
GFTERPPTKPLIAAVE

SEQ ID NO: 198901 - protein, 16 aa, Mycobacterium tuberculosis
FTERPPTKPLIAAVEG

SEQ ID NO: 198902 - protein, 16 aa, Mycobacterium tuberculosis
TERPPTKPLIAAVEGY

SEQ ID NO: 198903 - protein, 16 aa, Mycobacterium tuberculosis
ERPPTKPLIAAVEGYA

SEQ ID NO: 198904 - protein, 16 aa, Mycobacterium tuberculosis
RPPTKPLIAAVEGYAL

SEQ ID NO: 198905 - protein, 16 aa, Mycobacterium tuberculosis
PPTKPLIAAVEGYALA

SEQ ID NO: 198906 - protein, 16 aa, Mycobacterium tuberculosis
PTKPLIAAVEGYALAG

SEQ ID NO: 198907 - protein, 16 aa, Mycobacterium tuberculosis
TKPLIAAVEGYALAGG

SEQ ID NO: 198908 - protein, 16 aa, Mycobacterium tuberculosis
KPLIAAVEGYALAGGT

SEQ ID NO: 198909 - protein, 16 aa, Mycobacterium tuberculosis
PLIAAVEGYALAGGTE

SEQ ID NO: 198910 - protein, 16 aa, Mycobacterium tuberculosis
LIAAVEGYALAGGTEL

SEQ ID NO: 198911 - protein, 16 aa, Mycobacterium tuberculosis
IAAVEGYALAGGTELA

SEQ ID NO: 198912 - protein, 16 aa, Mycobacterium tuberculosis
AAVEGYALAGGTELAL

SEQ ID NO: 198913 - protein, 16 aa, Mycobacterium tuberculosis
AVEGYALAGGTELALA

SEQ ID NO: 198914 - protein, 16 aa, Mycobacterium tuberculosis
VEGYALAGGTELALAA

SEQ ID NO: 198915 - protein, 16 aa, Mycobacterium tuberculosis
EGYALAGGTELALAAD

SEQ ID NO: 198916 - protein, 16 aa, Mycobacterium tuberculosis
GYALAGGTELALAADL

SEQ ID NO: 198917 - protein, 16 aa, Mycobacterium tuberculosis
YALAGGTELALAADLI

SEQ ID NO: 198918 - protein, 16 aa, Mycobacterium tuberculosis
ALAGGTELALAADLIV

SEQ ID NO: 198919 - protein, 16 aa, Mycobacterium tuberculosis
LAGGTELALAADLIVA

SEQ ID NO: 198920 - protein, 16 aa, Mycobacterium tuberculosis
AGGTELALAADLIVAA

SEQ ID NO: 198921 - protein, 16 aa, Mycobacterium tuberculosis
GGTELALAADLIVAAR

SEQ ID NO: 198922 - protein, 16 aa, Mycobacterium tuberculosis
GTELALAADLIVAARD

SEQ ID NO: 198923 - protein, 16 aa, Mycobacterium tuberculosis
TELALAADLIVAARDS

SEQ ID NO: 198924 - protein, 16 aa, Mycobacterium tuberculosis
ELALAADLIVAARDSA

SEQ ID NO: 198925 - protein, 16 aa, Mycobacterium tuberculosis
LALAADLIVAARDSAF

SEQ ID NO: 198926 - protein, 16 aa, Mycobacterium tuberculosis
ALAADLIVAARDSAFG

SEQ ID NO: 198927 - protein, 16 aa, Mycobacterium tuberculosis
LAADLIVAARDSAFGI

SEQ ID NO: 198928 - protein, 16 aa, Mycobacterium tuberculosis
AADLIVAARDSAFGIP

SEQ ID NO: 198929 - protein, 16 aa, Mycobacterium tuberculosis
ADLIVAARDSAFGIPE

SEQ ID NO: 198930 - protein, 16 aa, Mycobacterium tuberculosis
DLIVAARDSAFGIPEV

SEQ ID NO: 198931 - protein, 16 aa, Mycobacterium tuberculosis
LIVAARDSAFGIPEVK

SEQ ID NO: 198932 - protein, 16 aa, Mycobacterium tuberculosis
IVAARDSAFGIPEVKR

SEQ ID NO: 198933 - protein, 16 aa, Mycobacterium tuberculosis
VAARDSAFGIPEVKRG

SEQ ID NO: 198934 - protein, 16 aa, Mycobacterium tuberculosis
AARDSAFGIPEVKRGL

SEQ ID NO: 198935 - protein, 16 aa, Mycobacterium tuberculosis
ARDSAFGIPEVKRGLV

SEQ ID NO: 198936 - protein, 16 aa, Mycobacterium tuberculosis
RDSAFGIPEVKRGLVA

SEQ ID NO: 198937 - protein, 16 aa, Mycobacterium tuberculosis
DSAFGIPEVKRGLVAG

SEQ ID NO: 198938 - protein, 16 aa, Mycobacterium tuberculosis
SAFGIPEVKRGLVAGG

SEQ ID NO: 198939 - protein, 16 aa, Mycobacterium tuberculosis
AFGIPEVKRGLVAGGG

SEQ ID NO: 198940 - protein, 16 aa, Mycobacterium tuberculosis
FGIPEVKRGLVAGGGG

SEQ ID NO: 198941 - protein, 16 aa, Mycobacterium tuberculosis
GIPEVKRGLVAGGGGL

SEQ ID NO: 198942 - protein, 16 aa, Mycobacterium tuberculosis
IPEVKRGLVAGGGGLL

SEQ ID NO: 198943 - protein, 16 aa, Mycobacterium tuberculosis
PEVKRGLVAGGGGLLR

SEQ ID NO: 198944 - protein, 16 aa, Mycobacterium tuberculosis
EVKRGLVAGGGGLLRL

SEQ ID NO: 198945 - protein, 16 aa, Mycobacterium tuberculosis
VKRGLVAGGGGLLRLP

SEQ ID NO: 198946 - protein, 16 aa, Mycobacterium tuberculosis
KRGLVAGGGGLLRLPE

SEQ ID NO: 198947 - protein, 16 aa, Mycobacterium tuberculosis
RGLVAGGGGLLRLPER

SEQ ID NO: 198948 - protein, 16 aa, Mycobacterium tuberculosis
GLVAGGGGLLRLPERI

SEQ ID NO: 198949 - protein, 16 aa, Mycobacterium tuberculosis
LVAGGGGLLRLPERIP

SEQ ID NO: 198950 - protein, 16 aa, Mycobacterium tuberculosis
VAGGGGLLRLPERIPY

SEQ ID NO: 198951 - protein, 16 aa, Mycobacterium tuberculosis
AGGGGLLRLPERIPYA

SEQ ID NO: 198952 - protein, 16 aa, Mycobacterium tuberculosis
GGGGLLRLPERIPYAI

SEQ ID NO: 198953 - protein, 16 aa, Mycobacterium tuberculosis
GGGLLRLPERIPYAIA

SEQ ID NO: 198954 - protein, 16 aa, Mycobacterium tuberculosis
GGLLRLPERIPYAIAM

SEQ ID NO: 198955 - protein, 16 aa, Mycobacterium tuberculosis
GLLRLPERIPYAIAME

SEQ ID NO: 198956 - protein, 16 aa, Mycobacterium tuberculosis
LLRLPERIPYAIAMEL

SEQ ID NO: 198957 - protein, 16 aa, Mycobacterium tuberculosis
LRLPERIPYAIAMELA

SEQ ID NO: 198958 - protein, 16 aa, Mycobacterium tuberculosis
RLPERIPYAIAMELAL

SEQ ID NO: 198959 - protein, 16 aa, Mycobacterium tuberculosis
LPERIPYAIAMELALT

SEQ ID NO: 198960 - protein, 16 aa, Mycobacterium tuberculosis
PERIPYAIAMELALTG

SEQ ID NO: 198961 - protein, 16 aa, Mycobacterium tuberculosis
ERIPYAIAMELALTGD

SEQ ID NO: 198962 - protein, 16 aa, Mycobacterium tuberculosis
RIPYAIAMELALTGDN

SEQ ID NO: 198963 - protein, 16 aa, Mycobacterium tuberculosis
IPYAIAMELALTGDNL

SEQ ID NO: 198964 - protein, 16 aa, Mycobacterium tuberculosis
PYAIAMELALTGDNLP

SEQ ID NO: 198965 - protein, 16 aa, Mycobacterium tuberculosis
YAIAMELALTGDNLPA

SEQ ID NO: 198966 - protein, 16 aa, Mycobacterium tuberculosis
AIAMELALTGDNLPAE

SEQ ID NO: 198967 - protein, 16 aa, Mycobacterium tuberculosis
IAMELALTGDNLPAER

SEQ ID NO: 198968 - protein, 16 aa, Mycobacterium tuberculosis
AMELALTGDNLPAERA

SEQ ID NO: 198969 - protein, 16 aa, Mycobacterium tuberculosis
MELALTGDNLPAERAH

SEQ ID NO: 198970 - protein, 16 aa, Mycobacterium tuberculosis
ELALTGDNLPAERAHE

SEQ ID NO: 198971 - protein, 16 aa, Mycobacterium tuberculosis
LALTGDNLPAERAHEL

SEQ ID NO: 198972 - protein, 16 aa, Mycobacterium tuberculosis
ALTGDNLPAERAHELG

SEQ ID NO: 198973 - protein, 16 aa, Mycobacterium tuberculosis
LTGDNLPAERAHELGL

SEQ ID NO: 198974 - protein, 16 aa, Mycobacterium tuberculosis
TGDNLPAERAHELGLV

SEQ ID NO: 198975 - protein, 16 aa, Mycobacterium tuberculosis
GDNLPAERAHELGLVN

SEQ ID NO: 198976 - protein, 16 aa, Mycobacterium tuberculosis
DNLPAERAHELGLVNV

SEQ ID NO: 198977 - protein, 16 aa, Mycobacterium tuberculosis
NLPAERAHELGLVNVL

SEQ ID NO: 198978 - protein, 16 aa, Mycobacterium tuberculosis
LPAERAHELGLVNVLA

SEQ ID NO: 198979 - protein, 16 aa, Mycobacterium tuberculosis
PAERAHELGLVNVLAE

SEQ ID NO: 198980 - protein, 16 aa, Mycobacterium tuberculosis
AERAHELGLVNVLAEP

SEQ ID NO: 198981 - protein, 16 aa, Mycobacterium tuberculosis
ERAHELGLVNVLAEPG

SEQ ID NO: 198982 - protein, 16 aa, Mycobacterium tuberculosis
RAHELGLVNVLAEPGT

SEQ ID NO: 198983 - protein, 16 aa, Mycobacterium tuberculosis
AHELGLVNVLAEPGTA

SEQ ID NO: 198984 - protein, 16 aa, Mycobacterium tuberculosis
HELGLVNVLAEPGTAL

SEQ ID NO: 198985 - protein, 16 aa, Mycobacterium tuberculosis
ELGLVNVLAEPGTALD

SEQ ID NO: 198986 - protein, 16 aa, Mycobacterium tuberculosis
LGLVNVLAEPGTALDA

SEQ ID NO: 198987 - protein, 16 aa, Mycobacterium tuberculosis
GLVNVLAEPGTALDAA

SEQ ID NO: 198988 - protein, 16 aa, Mycobacterium tuberculosis
LVNVLAEPGTALDAAI

SEQ ID NO: 198989 - protein, 16 aa, Mycobacterium tuberculosis
VNVLAEPGTALDAAIA

SEQ ID NO: 198990 - protein, 16 aa, Mycobacterium tuberculosis
NVLAEPGTALDAAIAL

SEQ ID NO: 198991 - protein, 16 aa, Mycobacterium tuberculosis
VLAEPGTALDAAIALA

SEQ ID NO: 198992 - protein, 16 aa, Mycobacterium tuberculosis
LAEPGTALDAAIALAE

SEQ ID NO: 198993 - protein, 16 aa, Mycobacterium tuberculosis
AEPGTALDAAIALAEK

SEQ ID NO: 198994 - protein, 16 aa, Mycobacterium tuberculosis
EPGTALDAAIALAEKI

SEQ ID NO: 198995 - protein, 16 aa, Mycobacterium tuberculosis
PGTALDAAIALAEKIT

SEQ ID NO: 198996 - protein, 16 aa, Mycobacterium tuberculosis
GTALDAAIALAEKITA

SEQ ID NO: 198997 - protein, 16 aa, Mycobacterium tuberculosis
TALDAAIALAEKITAN

SEQ ID NO: 198998 - protein, 16 aa, Mycobacterium tuberculosis
ALDAAIALAEKITANG

SEQ ID NO: 198999 - protein, 16 aa, Mycobacterium tuberculosis
LDAAIALAEKITANGP

SEQ ID NO: 199000 - protein, 16 aa, Mycobacterium tuberculosis
DAAIALAEKITANGPL

SEQ ID NO: 199001 - protein, 16 aa, Mycobacterium tuberculosis
AAIALAEKITANGPLA

SEQ ID NO: 199002 - protein, 16 aa, Mycobacterium tuberculosis
AIALAEKITANGPLAV

SEQ ID NO: 199003 - protein, 16 aa, Mycobacterium tuberculosis
IALAEKITANGPLAVV

SEQ ID NO: 199004 - protein, 16 aa, Mycobacterium tuberculosis
ALAEKITANGPLAVVA

SEQ ID NO: 199005 - protein, 16 aa, Mycobacterium tuberculosis
LAEKITANGPLAVVAT

SEQ ID NO: 199006 - protein, 16 aa, Mycobacterium tuberculosis
AEKITANGPLAVVATK

SEQ ID NO: 199007 - protein, 16 aa, Mycobacterium tuberculosis
EKITANGPLAVVATKR

SEQ ID NO: 199008 - protein, 16 aa, Mycobacterium tuberculosis
KITANGPLAVVATKRI

SEQ ID NO: 199009 - protein, 16 aa, Mycobacterium tuberculosis
ITANGPLAVVATKRII

SEQ ID NO: 199010 - protein, 16 aa, Mycobacterium tuberculosis
TANGPLAVVATKRIIT

SEQ ID NO: 199011 - protein, 16 aa, Mycobacterium tuberculosis
ANGPLAVVATKRIITE

SEQ ID NO: 199012 - protein, 16 aa, Mycobacterium tuberculosis
NGPLAVVATKRIITES

SEQ ID NO: 199013 - protein, 16 aa, Mycobacterium tuberculosis
GPLAVVATKRIITESR

SEQ ID NO: 199014 - protein, 16 aa, Mycobacterium tuberculosis
PLAVVATKRIITESRG

SEQ ID NO: 199015 - protein, 16 aa, Mycobacterium tuberculosis
LAVVATKRIITESRGW

SEQ ID NO: 199016 - protein, 16 aa, Mycobacterium tuberculosis
AVVATKRIITESRGWS

SEQ ID NO: 199017 - protein, 16 aa, Mycobacterium tuberculosis
VVATKRIITESRGWSP

SEQ ID NO: 199018 - protein, 16 aa, Mycobacterium tuberculosis
VATKRIITESRGWSPD

SEQ ID NO: 199019 - protein, 16 aa, Mycobacterium tuberculosis
ATKRIITESRGWSPDT

SEQ ID NO: 199020 - protein, 16 aa, Mycobacterium tuberculosis
TKRIITESRGWSPDTM

SEQ ID NO: 199021 - protein, 16 aa, Mycobacterium tuberculosis
KRIITESRGWSPDTMF

SEQ ID NO: 199022 - protein, 16 aa, Mycobacterium tuberculosis
RIITESRGWSPDTMFA

SEQ ID NO: 199023 - protein, 16 aa, Mycobacterium tuberculosis
IITESRGWSPDTMFAE

SEQ ID NO: 199024 - protein, 16 aa, Mycobacterium tuberculosis
ITESRGWSPDTMFAEQ

SEQ ID NO: 199025 - protein, 16 aa, Mycobacterium tuberculosis
TESRGWSPDTMFAEQM

SEQ ID NO: 199026 - protein, 16 aa, Mycobacterium tuberculosis
ESRGWSPDTMFAEQMK

SEQ ID NO: 199027 - protein, 16 aa, Mycobacterium tuberculosis
SRGWSPDTMFAEQMKI

SEQ ID NO: 199028 - protein, 16 aa, Mycobacterium tuberculosis
RGWSPDTMFAEQMKIL

SEQ ID NO: 199029 - protein, 16 aa, Mycobacterium tuberculosis
GWSPDTMFAEQMKILV

SEQ ID NO: 199030 - protein, 16 aa, Mycobacterium tuberculosis
WSPDTMFAEQMKILVP

SEQ ID NO: 199031 - protein, 16 aa, Mycobacterium tuberculosis
SPDTMFAEQMKILVPV

SEQ ID NO: 199032 - protein, 16 aa, Mycobacterium tuberculosis
PDTMFAEQMKILVPVF

SEQ ID NO: 199033 - protein, 16 aa, Mycobacterium tuberculosis
DTMFAEQMKILVPVFT

SEQ ID NO: 199034 - protein, 16 aa, Mycobacterium tuberculosis
TMFAEQMKILVPVFTS

SEQ ID NO: 199035 - protein, 16 aa, Mycobacterium tuberculosis
MFAEQMKILVPVFTSN

SEQ ID NO: 199036 - protein, 16 aa, Mycobacterium tuberculosis
FAEQMKILVPVFTSND

SEQ ID NO: 199037 - protein, 16 aa, Mycobacterium tuberculosis
AEQMKILVPVFTSNDA

SEQ ID NO: 199038 - protein, 16 aa, Mycobacterium tuberculosis
EQMKILVPVFTSNDAK

SEQ ID NO: 199039 - protein, 16 aa, Mycobacterium tuberculosis
QMKILVPVFTSNDAKE

SEQ ID NO: 199040 - protein, 16 aa, Mycobacterium tuberculosis
MKILVPVFTSNDAKEG

SEQ ID NO: 199041 - protein, 16 aa, Mycobacterium tuberculosis
KILVPVFTSNDAKEGA

SEQ ID NO: 199042 - protein, 16 aa, Mycobacterium tuberculosis
ILVPVFTSNDAKEGAI

SEQ ID NO: 199043 - protein, 16 aa, Mycobacterium tuberculosis
LVPVFTSNDAKEGAIA

SEQ ID NO: 199044 - protein, 16 aa, Mycobacterium tuberculosis
VPVFTSNDAKEGAIAF

SEQ ID NO: 199045 - protein, 16 aa, Mycobacterium tuberculosis
PVFTSNDAKEGAIAFA

SEQ ID NO: 199046 - protein, 16 aa, Mycobacterium tuberculosis
VFTSNDAKEGAIAFAE

SEQ ID NO: 199047 - protein, 16 aa, Mycobacterium tuberculosis
FTSNDAKEGAIAFAER

SEQ ID NO: 199048 - protein, 16 aa, Mycobacterium tuberculosis
TSNDAKEGAIAFAERR

SEQ ID NO: 199049 - protein, 16 aa, Mycobacterium tuberculosis
SNDAKEGAIAFAERRR

SEQ ID NO: 199050 - protein, 16 aa, Mycobacterium tuberculosis
NDAKEGAIAFAERRRP

SEQ ID NO: 199051 - protein, 16 aa, Mycobacterium tuberculosis
DAKEGAIAFAERRRPR

SEQ ID NO: 199052 - protein, 16 aa, Mycobacterium tuberculosis
AKEGAIAFAERRRPRW

SEQ ID NO: 199053 - protein, 16 aa, Mycobacterium tuberculosis
KEGAIAFAERRRPRWT

SEQ ID NO: 199054 - protein, 16 aa, Mycobacterium tuberculosis
EGAIAFAERRRPRWTG

SEQ ID NO: 199055 - protein, 16 aa, Mycobacterium tuberculosis
GAIAFAERRRPRWTGT

SEQ ID NO: 199056 - protein, 368 aa, Mycobacterium tuberculosis; identical to SEQ ID NO: 71

SEQ ID NO: 199057 - protein, 8 aa, Mycobacterium tuberculosis
MLWHAMPP

SEQ ID NO: 199058 - protein, 8 aa, Mycobacterium tuberculosis
WHAMPPEL

SEQ ID NO: 199059 - protein, 8 aa, Mycobacterium tuberculosis
AMPPELNT

SEQ ID NO: 199060 - protein, 8 aa, Mycobacterium tuberculosis
MPPELNTA

SEQ ID NO: 199061 - protein, 8 aa, Mycobacterium tuberculosis
ELNTARLM

SEQ ID NO: 199062 - protein, 8 aa, Mycobacterium tuberculosis
LMAGAGPA

SEQ ID NO: 199063 - protein, 8 aa, Mycobacterium tuberculosis
GPAPMLAA

SEQ ID NO: 199064 - protein, 8 aa, Mycobacterium tuberculosis
APMLAAAA

SEQ ID NO: 199065 - protein, 8 aa, Mycobacterium tuberculosis
MLAAAAGW

SEQ ID NO: 199066 - protein, 8 aa, Mycobacterium tuberculosis
AAAGWQTL

SEQ ID NO: 199067 - protein, 8 aa, Mycobacterium tuberculosis
WQTLSAAL

SEQ ID NO: 199068 - protein, 8 aa, Mycobacterium tuberculosis
TLSAALDA

SEQ ID NO: 199069 - protein, 8 aa, Mycobacterium tuberculosis
AALDAQAV

SEQ ID NO: 199070 - protein, 8 aa, Mycobacterium tuberculosis
AQAVELTA

SEQ ID NO: 199071 - protein, 8 aa, Mycobacterium tuberculosis
QAVELTAR

SEQ ID NO: 199072 - protein, 8 aa, Mycobacterium tuberculosis
LTARLNSL

SEQ ID NO: 199073 - protein, 8 aa, Mycobacterium tuberculosis
RLNSLGEA

SEQ ID NO: 199074 - protein, 8 aa, Mycobacterium tuberculosis
SLGEAWTG

SEQ ID NO: 199075 - protein, 8 aa, Mycobacterium tuberculosis
ALAAATPM

SEQ ID NO: 199076 - protein, 8 aa, Mycobacterium tuberculosis
LAAATPMV

SEQ ID NO: 199077 - protein, 8 aa, Mycobacterium tuberculosis
AAATPMVV

SEQ ID NO: 199078 - protein, 8 aa, Mycobacterium tuberculosis
AATPMVVW

SEQ ID NO: 199079 - protein, 8 aa, Mycobacterium tuberculosis
ATPMVVWL

SEQ ID NO: 199080 - protein, 8 aa, Mycobacterium tuberculosis
MVVWLQTA

SEQ ID NO: 199081 - protein, 8 aa, Mycobacterium tuberculosis
WLQTASTQ

SEQ ID NO: 199082 - protein, 8 aa, Mycobacterium tuberculosis
LQTASTQA

SEQ ID NO: 199083 - protein, 8 aa, Mycobacterium tuberculosis
QTASTQAK

SEQ ID NO: 199084 - protein, 8 aa, Mycobacterium tuberculosis
TQAKTRAM

SEQ ID NO: 199085 - protein, 8 aa, Mycobacterium tuberculosis
KTRAMQAT

SEQ ID NO: 199086 - protein, 8 aa, Mycobacterium tuberculosis
AMQATAQA

SEQ ID NO: 199087 - protein, 8 aa, Mycobacterium tuberculosis
MQATAQAA

SEQ ID NO: 199088 - protein, 8 aa, Mycobacterium tuberculosis
ATAQAAAY

SEQ ID NO: 199089 - protein, 8 aa, Mycobacterium tuberculosis
AQAAAYTQ

SEQ ID NO: 199090 - protein, 8 aa, Mycobacterium tuberculosis
QAAAYTQA

SEQ ID NO: 199091 - protein, 8 aa, Mycobacterium tuberculosis
AAAYTQAM

SEQ ID NO: 199092 - protein, 8 aa, Mycobacterium tuberculosis
QAMATTPS

SEQ ID NO: 199093 - protein, 8 aa, Mycobacterium tuberculosis
AMATTPSL

SEQ ID NO: 199094 - protein, 8 aa, Mycobacterium tuberculosis
TTPSLPEI

SEQ ID NO: 199095 - protein, 8 aa, Mycobacterium tuberculosis
SLPEIAAN

SEQ ID NO: 199096 - protein, 8 aa, Mycobacterium tuberculosis
LPEIAANH

SEQ ID NO: 199097 - protein, 8 aa, Mycobacterium tuberculosis
EIAANHIT

SEQ ID NO: 199098 - protein, 8 aa, Mycobacterium tuberculosis
NHITQAVL

SEQ ID NO: 199099 - protein, 8 aa, Mycobacterium tuberculosis
TQAVLTAT

SEQ ID NO: 199100 - protein, 8 aa, Mycobacterium tuberculosis
AVLTATNF

SEQ ID NO: 199101 - protein, 8 aa, Mycobacterium tuberculosis
VLTATNFF

SEQ ID NO: 199102 - protein, 8 aa, Mycobacterium tuberculosis
TATNFFGI

SEQ ID NO: 199103 - protein, 8 aa, Mycobacterium tuberculosis
FGINTIPI

SEQ ID NO: 199104 - protein, 8 aa, Mycobacterium tuberculosis
GINTIPIA

SEQ ID NO: 199105 - protein, 8 aa, Mycobacterium tuberculosis
NTIPIALT

SEQ ID NO: 199106 - protein, 8 aa, Mycobacterium tuberculosis
IPIALTEM

SEQ ID NO: 199107 - protein, 8 aa, Mycobacterium tuberculosis
IALTEMDY

SEQ ID NO: 199108 - protein, 8 aa, Mycobacterium tuberculosis
ALTEMDYF

SEQ ID NO: 199109 - protein, 8 aa, Mycobacterium tuberculosis
TEMDYFIR

SEQ ID NO: 199110 - protein, 8 aa, Mycobacterium tuberculosis
EMDYFIRM

SEQ ID NO: 199111 - protein, 8 aa, Mycobacterium tuberculosis
DYFIRMWN

SEQ ID NO: 199112 - protein, 8 aa, Mycobacterium tuberculosis
FIRMWNQA

SEQ ID NO: 199113 - protein, 8 aa, Mycobacterium tuberculosis
RMWNQAAL

SEQ ID NO: 199114 - protein, 8 aa, Mycobacterium tuberculosis
QAALAMEV

SEQ ID NO: 199115 - protein, 8 aa, Mycobacterium tuberculosis
AALAMEVY

SEQ ID NO: 199116 - protein, 8 aa, Mycobacterium tuberculosis
ALAMEVYQ

SEQ ID NO: 199117 - protein, 8 aa, Mycobacterium tuberculosis
LAMEVYQA

SEQ ID NO: 199118 - protein, 8 aa, Mycobacterium tuberculosis
EVYQAETA

SEQ ID NO: 199119 - protein, 8 aa, Mycobacterium tuberculosis
VYQAETAV

SEQ ID NO: 199120 - protein, 8 aa, Mycobacterium tuberculosis
AETAVNTL

SEQ ID NO: 199121 - protein, 8 aa, Mycobacterium tuberculosis
ETAVNTLF

SEQ ID NO: 199122 - protein, 8 aa, Mycobacterium tuberculosis
AVNTLFEK

SEQ ID NO: 199123 - protein, 8 aa, Mycobacterium tuberculosis
TLFEKLEP

SEQ ID NO: 199124 - protein, 8 aa, Mycobacterium tuberculosis
KLEPMASI

SEQ ID NO: 199125 - protein, 8 aa, Mycobacterium tuberculosis
LEPMASIL

SEQ ID NO: 199126 - protein, 8 aa, Mycobacterium tuberculosis
ILDPGASQ

SEQ ID NO: 199127 - protein, 8 aa, Mycobacterium tuberculosis
SQSTTNPI

SEQ ID NO: 199128 - protein, 8 aa, Mycobacterium tuberculosis
TTNPIFGM

SEQ ID NO: 199129 - protein, 8 aa, Mycobacterium tuberculosis
NPIFGMPS

SEQ ID NO: 199130 - protein, 8 aa, Mycobacterium tuberculosis
MPSPGSST

SEQ ID NO: 199131 - protein, 8 aa, Mycobacterium tuberculosis
SPGSSTPV

SEQ ID NO: 199132 - protein, 8 aa, Mycobacterium tuberculosis
GQLPPAAT

SEQ ID NO: 199133 - protein, 8 aa, Mycobacterium tuberculosis
QLPPAATQ

SEQ ID NO: 199134 - protein, 8 aa, Mycobacterium tuberculosis
LPPAATQT

SEQ ID NO: 199135 - protein, 8 aa, Mycobacterium tuberculosis
PPAATQTL

SEQ ID NO: 199136 - protein, 8 aa, Mycobacterium tuberculosis
TLGQLGEM

SEQ ID NO: 199137 - protein, 8 aa, Mycobacterium tuberculosis
EMSGPMQQ

SEQ ID NO: 199138 - protein, 8 aa, Mycobacterium tuberculosis
MQQLTQPL

SEQ ID NO: 199139 - protein, 8 aa, Mycobacterium tuberculosis
QLTQPLQQ

SEQ ID NO: 199140 - protein, 8 aa, Mycobacterium tuberculosis
LTQPLQQV

SEQ ID NO: 199141 - protein, 8 aa, Mycobacterium tuberculosis
PLQQVTSL

SEQ ID NO: 199142 - protein, 8 aa, Mycobacterium tuberculosis
LQQVTSLF

SEQ ID NO: 199143 - protein, 8 aa, Mycobacterium tuberculosis
VTSLFSQV

SEQ ID NO: 199144 - protein, 8 aa, Mycobacterium tuberculosis
NPADEEAA

SEQ ID NO: 199145 - protein, 8 aa, Mycobacterium tuberculosis
EEAAQMGL

SEQ ID NO: 199146 - protein, 8 aa, Mycobacterium tuberculosis
EAAQMGLL

SEQ ID NO: 199147 - protein, 8 aa, Mycobacterium tuberculosis
AQMGLLGT

SEQ ID NO: 199148 - protein, 8 aa, Mycobacterium tuberculosis
GLLGTSPL

SEQ ID NO: 199149 - protein, 8 aa, Mycobacterium tuberculosis
SPLSNHPL

SEQ ID NO: 199150 - protein, 8 aa, Mycobacterium tuberculosis
PLSNHPLA

SEQ ID NO: 199151 - protein, 8 aa, Mycobacterium tuberculosis
GPSAGAGL

SEQ ID NO: 199152 - protein, 8 aa, Mycobacterium tuberculosis
SAGAGLLR

SEQ ID NO: 199153 - protein, 8 aa, Mycobacterium tuberculosis
GLLRAESL

SEQ ID NO: 199154 - protein, 8 aa, Mycobacterium tuberculosis
LPGAGGSL

SEQ ID NO: 199155 - protein, 8 aa, Mycobacterium tuberculosis
SLTRTPLM

SEQ ID NO: 199156 - protein, 8 aa, Mycobacterium tuberculosis
TPLMSQLI

SEQ ID NO: 199157 - protein, 8 aa, Mycobacterium tuberculosis
LMSQLIEK

SEQ ID NO: 199158 - protein, 8 aa, Mycobacterium tuberculosis
SQLIEKPV

SEQ ID NO: 199159 - protein, 8 aa, Mycobacterium tuberculosis
QLIEKPVA

SEQ ID NO: 199160 - protein, 8 aa, Mycobacterium tuberculosis
KPVAPSVM

SEQ ID NO: 199161 - protein, 8 aa, Mycobacterium tuberculosis
APSVMPAA

SEQ ID NO: 199162 - protein, 8 aa, Mycobacterium tuberculosis
SVMPAAAA

SEQ ID NO: 199163 - protein, 8 aa, Mycobacterium tuberculosis
MPAAAAGS

SEQ ID NO: 199164 - protein, 8 aa, Mycobacterium tuberculosis
AAAAGSSA

SEQ ID NO: 199165 - protein, 8 aa, Mycobacterium tuberculosis
ATGGAAPV

SEQ ID NO: 199166 - protein, 8 aa, Mycobacterium tuberculosis
APVGAGAM

SEQ ID NO: 199167 - protein, 8 aa, Mycobacterium tuberculosis
AQSGGSTR

SEQ ID NO: 199168 - protein, 8 aa, Mycobacterium tuberculosis
RPGLVAPA

SEQ ID NO: 199169 - protein, 8 aa, Mycobacterium tuberculosis
GLVAPAPL

SEQ ID NO: 199170 - protein, 8 aa, Mycobacterium tuberculosis
LVAPAPLA

SEQ ID NO: 199171 - protein, 8 aa, Mycobacterium tuberculosis
EEDDEDDW

SEQ ID NO: 199172 - protein, 9 aa, Mycobacterium tuberculosis
MLWHAMPPE

SEQ ID NO: 199173 - protein, 9 aa, Mycobacterium tuberculosis
LWHAMPPEL

SEQ ID NO: 199174 - protein, 9 aa, Mycobacterium tuberculosis
AMPPELNTA

SEQ ID NO: 199175 - protein, 9 aa, Mycobacterium tuberculosis
MPPELNTAR

SEQ ID NO: 199176 - protein, 9 aa, Mycobacterium tuberculosis
PPELNTARL

SEQ ID NO: 199177 - protein, 9 aa, Mycobacterium tuberculosis
ELNTARLMA

SEQ ID NO: 199178 - protein, 9 aa, Mycobacterium tuberculosis
NTARLMAGA

SEQ ID NO: 199179 - protein, 9 aa, Mycobacterium tuberculosis
RLMAGAGPA

SEQ ID NO: 199180 - protein, 9 aa, Mycobacterium tuberculosis
MAGAGPAPM

SEQ ID NO: 199181 - protein, 9 aa, Mycobacterium tuberculosis
GPAPMLAAA

SEQ ID NO: 199182 - protein, 9 aa, Mycobacterium tuberculosis
APMLAAAAG

SEQ ID NO: 199183 - protein, 9 aa, Mycobacterium tuberculosis
MLAAAAGWQ

SEQ ID NO: 199184 - protein, 9 aa, Mycobacterium tuberculosis
AAAAGWQTL

SEQ ID NO: 199185 - protein, 9 aa, Mycobacterium tuberculosis
AAGWQTLSA

SEQ ID NO: 199186 - protein, 9 aa, Mycobacterium tuberculosis
GWQTLSAAL

SEQ ID NO: 199187 - protein, 9 aa, Mycobacterium tuberculosis
TLSAALDAQ

SEQ ID NO: 199188 - protein, 9 aa, Mycobacterium tuberculosis
LSAALDAQA

SEQ ID NO: 199189 - protein, 9 aa, Mycobacterium tuberculosis
SAALDAQAV

SEQ ID NO: 199190 - protein, 9 aa, Mycobacterium tuberculosis
ALDAQAVEL

SEQ ID NO: 199191 - protein, 9 aa, Mycobacterium tuberculosis
AQAVELTAR

SEQ ID NO: 199192 - protein, 9 aa, Mycobacterium tuberculosis
QAVELTARL

SEQ ID NO: 199193 - protein, 9 aa, Mycobacterium tuberculosis
ELTARLNSL

SEQ ID NO: 199194 - protein, 9 aa, Mycobacterium tuberculosis
RLNSLGEAW

SEQ ID NO: 199195 - protein, 9 aa, Mycobacterium tuberculosis
KALAAATPM

SEQ ID NO: 199196 - protein, 9 aa, Mycobacterium tuberculosis
ALAAATPMV

SEQ ID NO: 199197 - protein, 9 aa, Mycobacterium tuberculosis
LAAATPMVV

SEQ ID NO: 199198 - protein, 9 aa, Mycobacterium tuberculosis
AAATPMVVW

SEQ ID NO: 199199 - protein, 9 aa, Mycobacterium tuberculosis
AATPMVVWL

SEQ ID NO: 199200 - protein, 9 aa, Mycobacterium tuberculosis
PMVVWLQTA

SEQ ID NO: 199201 - protein, 9 aa, Mycobacterium tuberculosis
MVVWLQTAS

SEQ ID NO: 199202 - protein, 9 aa, Mycobacterium tuberculosis
WLQTASTQA

SEQ ID NO: 199203 - protein, 9 aa, Mycobacterium tuberculosis
LQTASTQAK

SEQ ID NO: 199204 - protein, 9 aa, Mycobacterium tuberculosis
TASTQAKTR

SEQ ID NO: 199205 - protein, 9 aa, Mycobacterium tuberculosis
STQAKTRAM

SEQ ID NO: 199206 - protein, 9 aa, Mycobacterium tuberculosis
KTRAMQATA

SEQ ID NO: 199207 - protein, 9 aa, Mycobacterium tuberculosis
RAMQATAQA

SEQ ID NO: 199208 - protein, 9 aa, Mycobacterium tuberculosis
AMQATAQAA

SEQ ID NO: 199209 - protein, 9 aa, Mycobacterium tuberculosis
MQATAQAAA

SEQ ID NO: 199210 - protein, 9 aa, Mycobacterium tuberculosis
QATAQAAAY

SEQ ID NO: 199211 - protein, 9 aa, Mycobacterium tuberculosis
AQAAAYTQA

SEQ ID NO: 199212 - protein, 9 aa, Mycobacterium tuberculosis
QAAAYTQAM

SEQ ID NO: 199213 - protein, 9 aa, Mycobacterium tuberculosis
TQAMATTPS

SEQ ID NO: 199214 - protein, 9 aa, Mycobacterium tuberculosis
QAMATTPSL

SEQ ID NO: 199215 - protein, 9 aa, Mycobacterium tuberculosis
ATTPSLPEI

SEQ ID NO: 199216 - protein, 9 aa, Mycobacterium tuberculosis
TTPSLPEIA

SEQ ID NO: 199217 - protein, 9 aa, Mycobacterium tuberculosis
TPSLPEIAA

SEQ ID NO: 199218 - protein, 9 aa, Mycobacterium tuberculosis
LPEIAANHI

SEQ ID NO: 199219 - protein, 9 aa, Mycobacterium tuberculosis
AANHITQAV

SEQ ID NO: 199220 - protein, 9 aa, Mycobacterium tuberculosis
HITQAVLTA

SEQ ID NO: 199221 - protein, 9 aa, Mycobacterium tuberculosis
QAVLTATNF

SEQ ID NO: 199222 - protein, 9 aa, Mycobacterium tuberculosis
AVLTATNFF

SEQ ID NO: 199223 - protein, 9 aa, Mycobacterium tuberculosis
LTATNFFGI

SEQ ID NO: 199224 - protein, 9 aa, Mycobacterium tuberculosis
FFGINTIPI

SEQ ID NO: 199225 - protein, 9 aa, Mycobacterium tuberculosis
FGINTIPIA

SEQ ID NO: 199226 - protein, 9 aa, Mycobacterium tuberculosis
GINTIPIAL

SEQ ID NO: 199227 - protein, 9 aa, Mycobacterium tuberculosis
NTIPIALTE

SEQ ID NO: 199228 - protein, 9 aa, Mycobacterium tuberculosis
TIPIALTEM

SEQ ID NO: 199229 - protein, 9 aa, Mycobacterium tuberculosis
PIALTEMDY

SEQ ID NO: 199230 - protein, 9 aa, Mycobacterium tuberculosis
IALTEMDYF

SEQ ID NO: 199231 - protein, 9 aa, Mycobacterium tuberculosis
ALTEMDYFI

SEQ ID NO: 199232 - protein, 9 aa, Mycobacterium tuberculosis
LTEMDYFIR

SEQ ID NO: 199233 - protein, 9 aa, Mycobacterium tuberculosis
TEMDYFIRM

SEQ ID NO: 199234 - protein, 9 aa, Mycobacterium tuberculosis
DYFIRMWNQ

SEQ ID NO: 199235 - protein, 9 aa, Mycobacterium tuberculosis
FIRMWNQAA

SEQ ID NO: 199236 - protein, 9 aa, Mycobacterium tuberculosis
IRMWNQAAL

SEQ ID NO: 199237 - protein, 9 aa, Mycobacterium tuberculosis
RMWNQAALA

SEQ ID NO: 199238 - protein, 9 aa, Mycobacterium tuberculosis
MWNQAALAM

SEQ ID NO: 199239 - protein, 9 aa, Mycobacterium tuberculosis
NQAALAMEV

SEQ ID NO: 199240 - protein, 9 aa, Mycobacterium tuberculosis
QAALAMEVY

SEQ ID NO: 199241 - protein, 9 aa, Mycobacterium tuberculosis
ALAMEVYQA

SEQ ID NO: 199242 - protein, 9 aa, Mycobacterium tuberculosis
AMEVYQAET

SEQ ID NO: 199243 - protein, 9 aa, Mycobacterium tuberculosis
MEVYQAETA

SEQ ID NO: 199244 - protein, 9 aa, Mycobacterium tuberculosis
EVYQAETAV

SEQ ID NO: 199245 - protein, 9 aa, Mycobacterium tuberculosis
YQAETAVNT

SEQ ID NO: 199246 - protein, 9 aa, Mycobacterium tuberculosis
QAETAVNTL

SEQ ID NO: 199247 - protein, 9 aa, Mycobacterium tuberculosis
AETAVNTLF

SEQ ID NO: 199248 - protein, 9 aa, Mycobacterium tuberculosis
ETAVNTLFE

SEQ ID NO: 199249 - protein, 9 aa, Mycobacterium tuberculosis
TAVNTLFEK

SEQ ID NO: 199250 - protein, 9 aa, Mycobacterium tuberculosis
AVNTLFEKL

SEQ ID NO: 199251 - protein, 9 aa, Mycobacterium tuberculosis
TLFEKLEPM

SEQ ID NO: 199252 - protein, 9 aa, Mycobacterium tuberculosis
EKLEPMASI

SEQ ID NO: 199253 - protein, 9 aa, Mycobacterium tuberculosis
KLEPMASIL

SEQ ID NO: 199254 - protein, 9 aa, Mycobacterium tuberculosis
SILDPGASQ

SEQ ID NO: 199255 - protein, 9 aa, Mycobacterium tuberculosis
ILDPGASQS

SEQ ID NO: 199256 - protein, 9 aa, Mycobacterium tuberculosis
SQSTTNPIF

SEQ ID NO: 199257 - protein, 9 aa, Mycobacterium tuberculosis
STTNPIFGM

SEQ ID NO: 199258 - protein, 9 aa, Mycobacterium tuberculosis
MPSPGSSTP

SEQ ID NO: 199259 - protein, 9 aa, Mycobacterium tuberculosis
TPVGQLPPA

SEQ ID NO: 199260 - protein, 9 aa, Mycobacterium tuberculosis
GQLPPAATQ

SEQ ID NO: 199261 - protein, 9 aa, Mycobacterium tuberculosis
QLPPAATQT

SEQ ID NO: 199262 - protein, 9 aa, Mycobacterium tuberculosis
LPPAATQTL

SEQ ID NO: 199263 - protein, 9 aa, Mycobacterium tuberculosis
QTLGQLGEM

SEQ ID NO: 199264 - protein, 9 aa, Mycobacterium tuberculosis
QLGEMSGPM

SEQ ID NO: 199265 - protein, 9 aa, Mycobacterium tuberculosis
GEMSGPMQQ

SEQ ID NO: 199266 - protein, 9 aa, Mycobacterium tuberculosis
EMSGPMQQL

SEQ ID NO: 199267 - protein, 9 aa, Mycobacterium tuberculosis
PMQQLTQPL

SEQ ID NO: 199268 - protein, 9 aa, Mycobacterium tuberculosis
QLTQPLQQV

SEQ ID NO: 199269 - protein, 9 aa, Mycobacterium tuberculosis
QPLQQVTSL

SEQ ID NO: 199270 - protein, 9 aa, Mycobacterium tuberculosis
QQVTSLFSQ

SEQ ID NO: 199271 - protein, 9 aa, Mycobacterium tuberculosis
QVTSLFSQV

SEQ ID NO: 199272 - protein, 9 aa, Mycobacterium tuberculosis
SLFSQVGGT

SEQ ID NO: 199273 - protein, 9 aa, Mycobacterium tuberculosis
NPADEEAAQ

SEQ ID NO: 199274 - protein, 9 aa, Mycobacterium tuberculosis
DEEAAQMGL

SEQ ID NO: 199275 - protein, 9 aa, Mycobacterium tuberculosis
EEAAQMGLL

SEQ ID NO: 199276 - protein, 9 aa, Mycobacterium tuberculosis
AQMGLLGTS

SEQ ID NO: 199277 - protein, 9 aa, Mycobacterium tuberculosis
MGLLGTSPL

SEQ ID NO: 199278 - protein, 9 aa, Mycobacterium tuberculosis
GLLGTSPLS

SEQ ID NO: 199279 - protein, 9 aa, Mycobacterium tuberculosis
TSPLSNHPL

SEQ ID NO: 199280 - protein, 9 aa, Mycobacterium tuberculosis
SPLSNHPLA

SEQ ID NO: 199281 - protein, 9 aa, Mycobacterium tuberculosis
GPSAGAGLL

SEQ ID NO: 199282 - protein, 9 aa, Mycobacterium tuberculosis
SLPGAGGSL

SEQ ID NO: 199283 - protein, 9 aa, Mycobacterium tuberculosis
LPGAGGSLT

SEQ ID NO: 199284 - protein, 9 aa, Mycobacterium tuberculosis
RTPLMSQLI

SEQ ID NO: 199285 - protein, 9 aa, Mycobacterium tuberculosis
PLMSQLIEK

SEQ ID NO: 199286 - protein, 9 aa, Mycobacterium tuberculosis
MSQLIEKPV

SEQ ID NO: 199287 - protein, 9 aa, Mycobacterium tuberculosis
IEKPVAPSV

SEQ ID NO: 199288 - protein, 9 aa, Mycobacterium tuberculosis
PVAPSVMPA

SEQ ID NO: 199289 - protein, 9 aa, Mycobacterium tuberculosis
APSVMPAAA

SEQ ID NO: 199290 - protein, 9 aa, Mycobacterium tuberculosis
MPAAAAGSS

SEQ ID NO: 199291 - protein, 9 aa, Mycobacterium tuberculosis
SATGGAAPV

SEQ ID NO: 199292 - protein, 9 aa, Mycobacterium tuberculosis
GAAPVGAGA

SEQ ID NO: 199293 - protein, 9 aa, Mycobacterium tuberculosis
AAPVGAGAM

SEQ ID NO: 199294 - protein, 9 aa, Mycobacterium tuberculosis
APVGAGAMG

SEQ ID NO: 199295 - protein, 9 aa, Mycobacterium tuberculosis
GAQSGGSTR

SEQ ID NO: 199296 - protein, 9 aa, Mycobacterium tuberculosis
GLVAPAPLA

SEQ ID NO: 199297 - protein, 10 aa, Mycobacterium tuberculosis
MLWHAMPPEL

SEQ ID NO: 199298 - protein, 10 aa, Mycobacterium tuberculosis
HAMPPELNTA

SEQ ID NO: 199299 - protein, 10 aa, Mycobacterium tuberculosis
MPPELNTARL

SEQ ID NO: 199300 - protein, 10 aa, Mycobacterium tuberculosis
LMAGAGPAPM

SEQ ID NO: 199301 - protein, 10 aa, Mycobacterium tuberculosis
MAGAGPAPML

SEQ ID NO: 199302 - protein, 10 aa, Mycobacterium tuberculosis
GPAPMLAAAA

SEQ ID NO: 199303 - protein, 10 aa, Mycobacterium tuberculosis
APMLAAAAGW

SEQ ID NO: 199304 - protein, 10 aa, Mycobacterium tuberculosis
MLAAAAGWQT

SEQ ID NO: 199305 - protein, 10 aa, Mycobacterium tuberculosis
LAAAAGWQTL

SEQ ID NO: 199306 - protein, 10 aa, Mycobacterium tuberculosis
AAAGWQTLSA

SEQ ID NO: 199307 - protein, 10 aa, Mycobacterium tuberculosis
AAGWQTLSAA

SEQ ID NO: 199308 - protein, 10 aa, Mycobacterium tuberculosis
TLSAALDAQA

SEQ ID NO: 199309 - protein, 10 aa, Mycobacterium tuberculosis
LSAALDAQAV

SEQ ID NO: 199310 - protein, 10 aa, Mycobacterium tuberculosis
AALDAQAVEL

SEQ ID NO: 199311 - protein, 10 aa, Mycobacterium tuberculosis
ALDAQAVELT

SEQ ID NO: 199312 - protein, 10 aa, Mycobacterium tuberculosis
DAQAVELTAR

SEQ ID NO: 199313 - protein, 10 aa, Mycobacterium tuberculosis
AQAVELTARL

SEQ ID NO: 199314 - protein, 10 aa, Mycobacterium tuberculosis
VELTARLNSL

SEQ ID NO: 199315 - protein, 10 aa, Mycobacterium tuberculosis
RLNSLGEAWT

SEQ ID NO: 199316 - protein, 10 aa, Mycobacterium tuberculosis
DKALAAATPM

SEQ ID NO: 199317 - protein, 10 aa, Mycobacterium tuberculosis
KALAAATPMV

SEQ ID NO: 199318 - protein, 10 aa, Mycobacterium tuberculosis
ALAAATPMVV

SEQ ID NO: 199319 - protein, 10 aa, Mycobacterium tuberculosis
LAAATPMVVW

SEQ ID NO: 199320 - protein, 10 aa, Mycobacterium tuberculosis
AAATPMVVWL

SEQ ID NO: 199321 - protein, 10 aa, Mycobacterium tuberculosis
TPMVVWLQTA

SEQ ID NO: 199322 - protein, 10 aa, Mycobacterium tuberculosis
MVVWLQTAST

SEQ ID NO: 199323 - protein, 10 aa, Mycobacterium tuberculosis
WLQTASTQAK

SEQ ID NO: 199324 - protein, 10 aa, Mycobacterium tuberculosis
QTASTQAKTR

SEQ ID NO: 199325 - protein, 10 aa, Mycobacterium tuberculosis
TQAKTRAMQA

SEQ ID NO: 199326 - protein, 10 aa, Mycobacterium tuberculosis
KTRAMQATAQ

SEQ ID NO: 199327 - protein, 10 aa, Mycobacterium tuberculosis
RAMQATAQAA

SEQ ID NO: 199328 - protein, 10 aa, Mycobacterium tuberculosis
AMQATAQAAA

SEQ ID NO: 199329 - protein, 10 aa, Mycobacterium tuberculosis
MQATAQAAAY

SEQ ID NO: 199330 - protein, 10 aa, Mycobacterium tuberculosis
AQAAAYTQAM

SEQ ID NO: 199331 - protein, 10 aa, Mycobacterium tuberculosis
QAAAYTQAMA

SEQ ID NO: 199332 - protein, 10 aa, Mycobacterium tuberculosis
TQAMATTPSL

SEQ ID NO: 199333 - protein, 10 aa, Mycobacterium tuberculosis
MATTPSLPEI

SEQ ID NO: 199334 - protein, 10 aa, Mycobacterium tuberculosis
TTPSLPEIAA

SEQ ID NO: 199335 - protein, 10 aa, Mycobacterium tuberculosis
SLPEIAANHI

SEQ ID NO: 199336 - protein, 10 aa, Mycobacterium tuberculosis
LPEIAANHIT

SEQ ID NO: 199337 - protein, 10 aa, Mycobacterium tuberculosis
EIAANHITQA

SEQ ID NO: 199338 - protein, 10 aa, Mycobacterium tuberculosis
IAANHITQAV

SEQ ID NO: 199339 - protein, 10 aa, Mycobacterium tuberculosis
AANHITQAVL

SEQ ID NO: 199340 - protein, 10 aa, Mycobacterium tuberculosis
TQAVLTATNF

SEQ ID NO: 199341 - protein, 10 aa, Mycobacterium tuberculosis
QAVLTATNFF

SEQ ID NO: 199342 - protein, 10 aa, Mycobacterium tuberculosis
VLTATNFFGI

SEQ ID NO: 199343 - protein, 10 aa, Mycobacterium tuberculosis
ATNFFGINTI

SEQ ID NO: 199344 - protein, 10 aa, Mycobacterium tuberculosis
NFFGINTIPI

SEQ ID NO: 199345 - protein, 10 aa, Mycobacterium tuberculosis
FGINTIPIAL

SEQ ID NO: 199346 - protein, 10 aa, Mycobacterium tuberculosis
NTIPIALTEM

SEQ ID NO: 199347 - protein, 10 aa, Mycobacterium tuberculosis
IPIALTEMDY

SEQ ID NO: 199348 - protein, 10 aa, Mycobacterium tuberculosis
PIALTEMDYF

SEQ ID NO: 199349 - protein, 10 aa, Mycobacterium tuberculosis
IALTEMDYFI

SEQ ID NO: 199350 - protein, 10 aa, Mycobacterium tuberculosis
ALTEMDYFIR

SEQ ID NO: 199351 - protein, 10 aa, Mycobacterium tuberculosis
LTEMDYFIRM

SEQ ID NO: 199352 - protein, 10 aa, Mycobacterium tuberculosis
TEMDYFIRMW

SEQ ID NO: 199353 - protein, 10 aa, Mycobacterium tuberculosis
FIRMWNQAAL

SEQ ID NO: 199354 - protein, 10 aa, Mycobacterium tuberculosis
RMWNQAALAM

SEQ ID NO: 199355 - protein, 10 aa, Mycobacterium tuberculosis
NQAALAMEVY

SEQ ID NO: 199356 - protein, 10 aa, Mycobacterium tuberculosis
LAMEVYQAET

SEQ ID NO: 199357 - protein, 10 aa, Mycobacterium tuberculosis
AMEVYQAETA

SEQ ID NO: 199358 - protein, 10 aa, Mycobacterium tuberculosis
MEVYQAETAV

SEQ ID NO: 199359 - protein, 10 aa, Mycobacterium tuberculosis
YQAETAVNTL

SEQ ID NO: 199360 - protein, 10 aa, Mycobacterium tuberculosis
QAETAVNTLF

SEQ ID NO: 199361 - protein, 10 aa, Mycobacterium tuberculosis
ETAVNTLFEK

SEQ ID NO: 199362 - protein, 10 aa, Mycobacterium tuberculosis
TAVNTLFEKL

SEQ ID NO: 199363 - protein, 10 aa, Mycobacterium tuberculosis
NTLFEKLEPM

SEQ ID NO: 199364 - protein, 10 aa, Mycobacterium tuberculosis
TLFEKLEPMA

SEQ ID NO: 199365 - protein, 10 aa, Mycobacterium tuberculosis
PMASILDPGA

SEQ ID NO: 199366 - protein, 10 aa, Mycobacterium tuberculosis
SILDPGASQS

SEQ ID NO: 199367 - protein, 10 aa, Mycobacterium tuberculosis
ILDPGASQST

SEQ ID NO: 199368 - protein, 10 aa, Mycobacterium tuberculosis
GASQSTTNPI

SEQ ID NO: 199369 - protein, 10 aa, Mycobacterium tuberculosis
TTNPIFGMPS

SEQ ID NO: 199370 - protein, 10 aa, Mycobacterium tuberculosis
MPSPGSSTPV

SEQ ID NO: 199371 - protein, 10 aa, Mycobacterium tuberculosis
TPVGQLPPAA

SEQ ID NO: 199372 - protein, 10 aa, Mycobacterium tuberculosis
GQLPPAATQT

SEQ ID NO: 199373 - protein, 10 aa, Mycobacterium tuberculosis
QLPPAATQTL

SEQ ID NO: 199374 - protein, 10 aa, Mycobacterium tuberculosis
GQLGEMSGPM

SEQ ID NO: 199375 - protein, 10 aa, Mycobacterium tuberculosis
GEMSGPMQQL

SEQ ID NO: 199376 - protein, 10 aa, Mycobacterium tuberculosis
EMSGPMQQLT

SEQ ID NO: 199377 - protein, 10 aa, Mycobacterium tuberculosis
GPMQQLTQPL

SEQ ID NO: 199378 - protein, 10 aa, Mycobacterium tuberculosis
QQLTQPLQQV

SEQ ID NO: 199379 - protein, 10 aa, Mycobacterium tuberculosis
QLTQPLQQVT

SEQ ID NO: 199380 - protein, 10 aa, Mycobacterium tuberculosis
TQPLQQVTSL

SEQ ID NO: 199381 - protein, 10 aa, Mycobacterium tuberculosis
QPLQQVTSLF

SEQ ID NO: 199382 - protein, 10 aa, Mycobacterium tuberculosis
QQVTSLFSQV

SEQ ID NO: 199383 - protein, 10 aa, Mycobacterium tuberculosis
NPADEEAAQM

SEQ ID NO: 199384 - protein, 10 aa, Mycobacterium tuberculosis
DEEAAQMGLL

SEQ ID NO: 199385 - protein, 10 aa, Mycobacterium tuberculosis
AQMGLLGTSP

SEQ ID NO: 199386 - protein, 10 aa, Mycobacterium tuberculosis
QMGLLGTSPL

SEQ ID NO: 199387 - protein, 10 aa, Mycobacterium tuberculosis
GTSPLSNHPL

SEQ ID NO: 199388 - protein, 10 aa, Mycobacterium tuberculosis
HPLAGGSGPS

SEQ ID NO: 199389 - protein, 10 aa, Mycobacterium tuberculosis
PLAGGSGPSA

SEQ ID NO: 199390 - protein, 10 aa, Mycobacterium tuberculosis
LLRAESLPGA

SEQ ID NO: 199391 - protein, 10 aa, Mycobacterium tuberculosis
AESLPGAGGS

SEQ ID NO: 199392 - protein, 10 aa, Mycobacterium tuberculosis
SLPGAGGSLT

SEQ ID NO: 199393 - protein, 10 aa, Mycobacterium tuberculosis
SLTRTPLMSQ

SEQ ID NO: 199394 - protein, 10 aa, Mycobacterium tuberculosis
LTRTPLMSQL

SEQ ID NO: 199395 - protein, 10 aa, Mycobacterium tuberculosis
TPLMSQLIEK

SEQ ID NO: 199396 - protein, 10 aa, Mycobacterium tuberculosis
LMSQLIEKPV

SEQ ID NO: 199397 - protein, 10 aa, Mycobacterium tuberculosis
LIEKPVAPSV

SEQ ID NO: 199398 - protein, 10 aa, Mycobacterium tuberculosis
KPVAPSVMPA

SEQ ID NO: 199399 - protein, 10 aa, Mycobacterium tuberculosis
PVAPSVMPAA

SEQ ID NO: 199400 - protein, 10 aa, Mycobacterium tuberculosis
APSVMPAAAA

SEQ ID NO: 199401 - protein, 10 aa, Mycobacterium tuberculosis
SVMPAAAAGS

SEQ ID NO: 199402 - protein, 10 aa, Mycobacterium tuberculosis
MPAAAAGSSA

SEQ ID NO: 199403 - protein, 10 aa, Mycobacterium tuberculosis
SSATGGAAPV

SEQ ID NO: 199404 - protein, 10 aa, Mycobacterium tuberculosis
GAAPVGAGAM

SEQ ID NO: 199405 - protein, 10 aa, Mycobacterium tuberculosis
STRPGLVAPA

SEQ ID NO: 199406 - protein, 10 aa, Mycobacterium tuberculosis
RPGLVAPAPL

SEQ ID NO: 199407 - protein, 10 aa, Mycobacterium tuberculosis
VAPAPLAQER

SEQ ID NO: 199408 - protein, 11 aa, Mycobacterium tuberculosis
HAMPPELNTAR

SEQ ID NO: 199409 - protein, 11 aa, Mycobacterium tuberculosis
AMPPELNTARL

SEQ ID NO: 199410 - protein, 11 aa, Mycobacterium tuberculosis
MPPELNTARLM

SEQ ID NO: 199411 - protein, 11 aa, Mycobacterium tuberculosis
ELNTARLMAGA

SEQ ID NO: 199412 - protein, 11 aa, Mycobacterium tuberculosis
RLMAGAGPAPM

SEQ ID NO: 199413 - protein, 11 aa, Mycobacterium tuberculosis
LMAGAGPAPML

SEQ ID NO: 199414 - protein, 11 aa, Mycobacterium tuberculosis
MAGAGPAPMLA

SEQ ID NO: 199415 - protein, 11 aa, Mycobacterium tuberculosis
PMLAAAAGWQT

SEQ ID NO: 199416 - protein, 11 aa, Mycobacterium tuberculosis
MLAAAAGWQTL

SEQ ID NO: 199417 - protein, 11 aa, Mycobacterium tuberculosis
AAAAGWQTLSA

SEQ ID NO: 199418 - protein, 11 aa, Mycobacterium tuberculosis
AAAGWQTLSAA

SEQ ID NO: 199419 - protein, 11 aa, Mycobacterium tuberculosis
AAGWQTLSAAL

SEQ ID NO: 199420 - protein, 11 aa, Mycobacterium tuberculosis
TLSAALDAQAV

SEQ ID NO: 199421 - protein, 11 aa, Mycobacterium tuberculosis
SAALDAQAVEL

SEQ ID NO: 199422 - protein, 11 aa, Mycobacterium tuberculosis
ALDAQAVELTA

SEQ ID NO: 199423 - protein, 11 aa, Mycobacterium tuberculosis
LTARLNSLGEA

SEQ ID NO: 199424 - protein, 11 aa, Mycobacterium tuberculosis
EAWTGGGSDKA

SEQ ID NO: 199425 - protein, 11 aa, Mycobacterium tuberculosis
WTGGGSDKALA

SEQ ID NO: 199426 - protein, 11 aa, Mycobacterium tuberculosis
KALAAATPMVV

SEQ ID NO: 199427 - protein, 11 aa, Mycobacterium tuberculosis
ALAAATPMVVW

SEQ ID NO: 199428 - protein, 11 aa, Mycobacterium tuberculosis
LAAATPMVVWL

SEQ ID NO: 199429 - protein, 11 aa, Mycobacterium tuberculosis
ATPMVVWLQTA

SEQ ID NO: 199430 - protein, 11 aa, Mycobacterium tuberculosis
TPMVVWLQTAS

SEQ ID NO: 199431 - protein, 11 aa, Mycobacterium tuberculosis
PMVVWLQTAST

SEQ ID NO: 199432 - protein, 11 aa, Mycobacterium tuberculosis
MVVWLQTASTQ

SEQ ID NO: 199433 - protein, 11 aa, Mycobacterium tuberculosis
VWLQTASTQAK

SEQ ID NO: 199434 - protein, 11 aa, Mycobacterium tuberculosis
WLQTASTQAKT

SEQ ID NO: 199435 - protein, 11 aa, Mycobacterium tuberculosis
LQTASTQAKTR

SEQ ID NO: 199436 - protein, 11 aa, Mycobacterium tuberculosis
QTASTQAKTRA

SEQ ID NO: 199437 - protein, 11 aa, Mycobacterium tuberculosis
TASTQAKTRAM

SEQ ID NO: 199438 - protein, 11 aa, Mycobacterium tuberculosis
KTRAMQATAQA

SEQ ID NO: 199439 - protein, 11 aa, Mycobacterium tuberculosis
RAMQATAQAAA

SEQ ID NO: 199440 - protein, 11 aa, Mycobacterium tuberculosis
AMQATAQAAAY

SEQ ID NO: 199441 - protein, 11 aa, Mycobacterium tuberculosis
MQATAQAAAYT

SEQ ID NO: 199442 - protein, 11 aa, Mycobacterium tuberculosis
ATAQAAAYTQA

SEQ ID NO: 199443 - protein, 11 aa, Mycobacterium tuberculosis
TAQAAAYTQAM

SEQ ID NO: 199444 - protein, 11 aa, Mycobacterium tuberculosis
AQAAAYTQAMA

SEQ ID NO: 199445 - protein, 11 aa, Mycobacterium tuberculosis
QAAAYTQAMAT

SEQ ID NO: 199446 - protein, 11 aa, Mycobacterium tuberculosis
YTQAMATTPSL

SEQ ID NO: 199447 - protein, 11 aa, Mycobacterium tuberculosis
AMATTPSLPEI

SEQ ID NO: 199448 - protein, 11 aa, Mycobacterium tuberculosis
MATTPSLPEIA

SEQ ID NO: 199449 - protein, 11 aa, Mycobacterium tuberculosis
SLPEIAANHIT

SEQ ID NO: 199450 - protein, 11 aa, Mycobacterium tuberculosis
EIAANHITQAV

SEQ ID NO: 199451 - protein, 11 aa, Mycobacterium tuberculosis
IAANHITQAVL

SEQ ID NO: 199452 - protein, 11 aa, Mycobacterium tuberculosis
ITQAVLTATNF

SEQ ID NO: 199453 - protein, 11 aa, Mycobacterium tuberculosis
TQAVLTATNFF

SEQ ID NO: 199454 - protein, 11 aa, Mycobacterium tuberculosis
AVLTATNFFGI

SEQ ID NO: 199455 - protein, 11 aa, Mycobacterium tuberculosis
LTATNFFGINT

SEQ ID NO: 199456 - protein, 11 aa, Mycobacterium tuberculosis
TATNFFGINTI

SEQ ID NO: 199457 - protein, 11 aa, Mycobacterium tuberculosis
TNFFGINTIPI

SEQ ID NO: 199458 - protein, 11 aa, Mycobacterium tuberculosis
FFGINTIPIAL

SEQ ID NO: 199459 - protein, 11 aa, Mycobacterium tuberculosis
TIPIALTEMDY

SEQ ID NO: 199460 - protein, 11 aa, Mycobacterium tuberculosis
IPIALTEMDYF

SEQ ID NO: 199461 - protein, 11 aa, Mycobacterium tuberculosis
IALTEMDYFIR

SEQ ID NO: 199462 - protein, 11 aa, Mycobacterium tuberculosis
ALTEMDYFIRM

SEQ ID NO: 199463 - protein, 11 aa, Mycobacterium tuberculosis
EMDYFIRMWNQ

SEQ ID NO: 199464 - protein, 11 aa, Mycobacterium tuberculosis
MDYFIRMWNQA

SEQ ID NO: 199465 - protein, 11 aa, Mycobacterium tuberculosis
DYFIRMWNQAA

SEQ ID NO: 199466 - protein, 11 aa, Mycobacterium tuberculosis
YFIRMWNQAAL

SEQ ID NO: 199467 - protein, 11 aa, Mycobacterium tuberculosis
FIRMWNQAALA

SEQ ID NO: 199468 - protein, 11 aa, Mycobacterium tuberculosis
IRMWNQAALAM

SEQ ID NO: 199469 - protein, 11 aa, Mycobacterium tuberculosis
QAALAMEVYQA

SEQ ID NO: 199470 - protein, 11 aa, Mycobacterium tuberculosis
ALAMEVYQAET

SEQ ID NO: 199471 - protein, 11 aa, Mycobacterium tuberculosis
LAMEVYQAETA

SEQ ID NO: 199472 - protein, 11 aa, Mycobacterium tuberculosis
AMEVYQAETAV

SEQ ID NO: 199473 - protein, 11 aa, Mycobacterium tuberculosis
EVYQAETAVNT

SEQ ID NO: 199474 - protein, 11 aa, Mycobacterium tuberculosis
VYQAETAVNTL

SEQ ID NO: 199475 - protein, 11 aa, Mycobacterium tuberculosis
YQAETAVNTLF

SEQ ID NO: 199476 - protein, 11 aa, Mycobacterium tuberculosis
AETAVNTLFEK

SEQ ID NO: 199477 - protein, 11 aa, Mycobacterium tuberculosis
ETAVNTLFEKL

SEQ ID NO: 199478 - protein, 11 aa, Mycobacterium tuberculosis
NTLFEKLEPMA

SEQ ID NO: 199479 - protein, 11 aa, Mycobacterium tuberculosis
TLFEKLEPMAS

SEQ ID NO: 199480 - protein, 11 aa, Mycobacterium tuberculosis
FEKLEPMASIL

SEQ ID NO: 199481 - protein, 11 aa, Mycobacterium tuberculosis
EPMASILDPGA

SEQ ID NO: 199482 - protein, 11 aa, Mycobacterium tuberculosis
SILDPGASQST

SEQ ID NO: 199483 - protein, 11 aa, Mycobacterium tuberculosis
ILDPGASQSTT

SEQ ID NO: 199484 - protein, 11 aa, Mycobacterium tuberculosis
GASQSTTNPIF

SEQ ID NO: 199485 - protein, 11 aa, Mycobacterium tuberculosis
SQSTTNPIFGM

SEQ ID NO: 199486 - protein, 11 aa, Mycobacterium tuberculosis
GMPSPGSSTPV

SEQ ID NO: 199487 - protein, 11 aa, Mycobacterium tuberculosis
MPSPGSSTPVG

SEQ ID NO: 199488 - protein, 11 aa, Mycobacterium tuberculosis
SPGSSTPVGQL

SEQ ID NO: 199489 - protein, 11 aa, Mycobacterium tuberculosis
TPVGQLPPAAT

SEQ ID NO: 199490 - protein, 11 aa, Mycobacterium tuberculosis
GQLPPAATQTL

SEQ ID NO: 199491 - protein, 11 aa, Mycobacterium tuberculosis
ATQTLGQLGEM

SEQ ID NO: 199492 - protein, 11 aa, Mycobacterium tuberculosis
QLGEMSGPMQQ

SEQ ID NO: 199493 - protein, 11 aa, Mycobacterium tuberculosis
EMSGPMQQLTQ

SEQ ID NO: 199494 - protein, 11 aa, Mycobacterium tuberculosis
MQQLTQPLQQV

SEQ ID NO: 199495 - protein, 11 aa, Mycobacterium tuberculosis
LTQPLQQVTSL

SEQ ID NO: 199496 - protein, 11 aa, Mycobacterium tuberculosis
TQPLQQVTSLF

SEQ ID NO: 199497 - protein, 11 aa, Mycobacterium tuberculosis
PLQQVTSLFSQ

SEQ ID NO: 199498 - protein, 11 aa, Mycobacterium tuberculosis
LQQVTSLFSQV

SEQ ID NO: 199499 - protein, 11 aa, Mycobacterium tuberculosis
EEAAQMGLLGT

SEQ ID NO: 199500 - protein, 11 aa, Mycobacterium tuberculosis
AQMGLLGTSPL

SEQ ID NO: 199501 - protein, 11 aa, Mycobacterium tuberculosis
HPLAGGSGPSA

SEQ ID NO: 199502 - protein, 11 aa, Mycobacterium tuberculosis
GLLRAESLPGA

SEQ ID NO: 199503 - protein, 11 aa, Mycobacterium tuberculosis
AESLPGAGGSL

SEQ ID NO: 199504 - protein, 11 aa, Mycobacterium tuberculosis
SLPGAGGSLTR

SEQ ID NO: 199505 - protein, 11 aa, Mycobacterium tuberculosis
LPGAGGSLTRT

SEQ ID NO: 199506 - protein, 11 aa, Mycobacterium tuberculosis
SLTRTPLMSQL

SEQ ID NO: 199507 - protein, 11 aa, Mycobacterium tuberculosis
LTRTPLMSQLI

SEQ ID NO: 199508 - protein, 11 aa, Mycobacterium tuberculosis
RTPLMSQLIEK

SEQ ID NO: 199509 - protein, 11 aa, Mycobacterium tuberculosis
PLMSQLIEKPV

SEQ ID NO: 199510 - protein, 11 aa, Mycobacterium tuberculosis
LMSQLIEKPVA

SEQ ID NO: 199511 - protein, 11 aa, Mycobacterium tuberculosis
QLIEKPVAPSV

SEQ ID NO: 199512 - protein, 11 aa, Mycobacterium tuberculosis
LIEKPVAPSVM

SEQ ID NO: 199513 - protein, 11 aa, Mycobacterium tuberculosis
KPVAPSVMPAA

SEQ ID NO: 199514 - protein, 11 aa, Mycobacterium tuberculosis
APSVMPAAAAG

SEQ ID NO: 199515 - protein, 11 aa, Mycobacterium tuberculosis
VMPAAAAGSSA

SEQ ID NO: 199516 - protein, 11 aa, Mycobacterium tuberculosis
MPAAAAGSSAT

SEQ ID NO: 199517 - protein, 11 aa, Mycobacterium tuberculosis
AAAGSSATGGA

SEQ ID NO: 199518 - protein, 11 aa, Mycobacterium tuberculosis
AQSGGSTRPGL

SEQ ID NO: 199519 - protein, 11 aa, Mycobacterium tuberculosis
TRPGLVAPAPL

SEQ ID NO: 199520 - protein, 11 aa, Mycobacterium tuberculosis
RPGLVAPAPLA

SEQ ID NO: 199521 - protein, 11 aa, Mycobacterium tuberculosis
LVAPAPLAQER

SEQ ID NO: 199522 - protein, 96 aa, Mycobacterium tuberculosis; identical to SEQ ID NO: 7

SEQ ID NO: 199523 - protein, 8 aa, Mycobacterium tuberculosis
MSQIMYNY

SEQ ID NO: 199524 - protein, 8 aa, Mycobacterium tuberculosis
SQIMYNYP

SEQ ID NO: 199525 - protein, 8 aa, Mycobacterium tuberculosis
QIMYNYPA

SEQ ID NO: 199526 - protein, 8 aa, Mycobacterium tuberculosis
IMYNYPAM

SEQ ID NO: 199527 - protein, 8 aa, Mycobacterium tuberculosis
MYNYPAML

SEQ ID NO: 199528 - protein, 8 aa, Mycobacterium tuberculosis
YPAMLGHA

SEQ ID NO: 199529 - protein, 8 aa, Mycobacterium tuberculosis
HAGDMAGY

SEQ ID NO: 199530 - protein, 8 aa, Mycobacterium tuberculosis
MAGYAGTL

SEQ ID NO: 199531 - protein, 8 aa, Mycobacterium tuberculosis
YAGTLQSL

SEQ ID NO: 199532 - protein, 8 aa, Mycobacterium tuberculosis
GTLQSLGA

SEQ ID NO: 199533 - protein, 8 aa, Mycobacterium tuberculosis
LQSLGAEI

SEQ ID NO: 199534 - protein, 8 aa, Mycobacterium tuberculosis
SLGAEIAV

SEQ ID NO: 199535 - protein, 8 aa, Mycobacterium tuberculosis
AEIAVEQA

SEQ ID NO: 199536 - protein, 8 aa, Mycobacterium tuberculosis
EIAVEQAA

SEQ ID NO: 199537 - protein, 8 aa, Mycobacterium tuberculosis
IAVEQAAL

SEQ ID NO: 199538 - protein, 8 aa, Mycobacterium tuberculosis
QAALQSAW

SEQ ID NO: 199539 - protein, 8 aa, Mycobacterium tuberculosis
TGITYQAW

SEQ ID NO: 199540 - protein, 8 aa, Mycobacterium tuberculosis
ITYQAWQA

SEQ ID NO: 199541 - protein, 8 aa, Mycobacterium tuberculosis
YQAWQAQW

SEQ ID NO: 199542 - protein, 8 aa, Mycobacterium tuberculosis
WQAQWNQA

SEQ ID NO: 199543 - protein, 8 aa, Mycobacterium tuberculosis
QAQWNQAM

SEQ ID NO: 199544 - protein, 8 aa, Mycobacterium tuberculosis
NQAMEDLV

SEQ ID NO: 199545 - protein, 8 aa, Mycobacterium tuberculosis
QAMEDLVR

SEQ ID NO: 199546 - protein, 8 aa, Mycobacterium tuberculosis
AMEDLVRA

SEQ ID NO: 199547 - protein, 8 aa, Mycobacterium tuberculosis
MEDLVRAY

SEQ ID NO: 199548 - protein, 8 aa, Mycobacterium tuberculosis
DLVRAYHA

SEQ ID NO: 199549 - protein, 8 aa, Mycobacterium tuberculosis
LVRAYHAM

SEQ ID NO: 199550 - protein, 8 aa, Mycobacterium tuberculosis
AMSSTHEA

SEQ ID NO: 199551 - protein, 8 aa, Mycobacterium tuberculosis
STHEANTM

SEQ ID NO: 199552 - protein, 8 aa, Mycobacterium tuberculosis
EANTMAMM

SEQ ID NO: 199553 - protein, 8 aa, Mycobacterium tuberculosis
NTMAMMAR

SEQ ID NO: 199554 - protein, 8 aa, Mycobacterium tuberculosis
AMMARDTA

SEQ ID NO: 199555 - protein, 8 aa, Mycobacterium tuberculosis
MARDTAEA

SEQ ID NO: 199556 - protein, 8 aa, Mycobacterium tuberculosis
DTAEAAKW

SEQ ID NO: 199557 - protein, 9 aa, Mycobacterium tuberculosis
SQIMYNYPA

SEQ ID NO: 199558 - protein, 9 aa, Mycobacterium tuberculosis
QIMYNYPAM

SEQ ID NO: 199559 - protein, 9 aa, Mycobacterium tuberculosis
IMYNYPAML

SEQ ID NO: 199560 - protein, 9 aa, Mycobacterium tuberculosis
YPAMLGHAG

SEQ ID NO: 199561 - protein, 9 aa, Mycobacterium tuberculosis
MLGHAGDMA

SEQ ID NO: 199562 - protein, 9 aa, Mycobacterium tuberculosis
DMAGYAGTL

SEQ ID NO: 199563 - protein, 9 aa, Mycobacterium tuberculosis
GYAGTLQSL

SEQ ID NO: 199564 - protein, 9 aa, Mycobacterium tuberculosis
TLQSLGAEI

SEQ ID NO: 199565 - protein, 9 aa, Mycobacterium tuberculosis
LQSLGAEIA

SEQ ID NO: 199566 - protein, 9 aa, Mycobacterium tuberculosis
AEIAVEQAA

SEQ ID NO: 199567 - protein, 9 aa, Mycobacterium tuberculosis
EIAVEQAAL

SEQ ID NO: 199568 - protein, 9 aa, Mycobacterium tuberculosis
EQAALQSAW

SEQ ID NO: 199569 - protein, 9 aa, Mycobacterium tuberculosis
SAWQGDTGI

SEQ ID NO: 199570 - protein, 9 aa, Mycobacterium tuberculosis
WQGDTGITY

SEQ ID NO: 199571 - protein, 9 aa, Mycobacterium tuberculosis
DTGITYQAW

SEQ ID NO: 199572 - protein, 9 aa, Mycobacterium tuberculosis
TYQAWQAQW

SEQ ID NO: 199573 - protein, 9 aa, Mycobacterium tuberculosis
WQAQWNQAM

SEQ ID NO: 199574 - protein, 9 aa, Mycobacterium tuberculosis
QAMEDLVRA

SEQ ID NO: 199575 - protein, 9 aa, Mycobacterium tuberculosis
AMEDLVRAY

SEQ ID NO: 199576 - protein, 9 aa, Mycobacterium tuberculosis
DLVRAYHAM

SEQ ID NO: 199577 - protein, 9 aa, Mycobacterium tuberculosis
RAYHAMSST

SEQ ID NO: 199578 - protein, 9 aa, Mycobacterium tuberculosis
HAMSSTHEA

SEQ ID NO: 199579 - protein, 9 aa, Mycobacterium tuberculosis
THEANTMAM

SEQ ID NO: 199580 - protein, 9 aa, Mycobacterium tuberculosis
EANTMAMMA

SEQ ID NO: 199581 - protein, 9 aa, Mycobacterium tuberculosis
MAMMARDTA

SEQ ID NO: 199582 - protein, 9 aa, Mycobacterium tuberculosis
MMARDTAEA

SEQ ID NO: 199583 - protein, 10 aa, Mycobacterium tuberculosis
MSQIMYNYPA

SEQ ID NO: 199584 - protein, 10 aa, Mycobacterium tuberculosis
SQIMYNYPAM

SEQ ID NO: 199585 - protein, 10 aa, Mycobacterium tuberculosis
QIMYNYPAML

SEQ ID NO: 199586 - protein, 10 aa, Mycobacterium tuberculosis
IMYNYPAMLG

SEQ ID NO: 199587 - protein, 10 aa, Mycobacterium tuberculosis
YPAMLGHAGD

SEQ ID NO: 199588 - protein, 10 aa, Mycobacterium tuberculosis
AMLGHAGDMA

SEQ ID NO: 199589 - protein, 10 aa, Mycobacterium tuberculosis
LGHAGDMAGY

SEQ ID NO: 199590 - protein, 10 aa, Mycobacterium tuberculosis
TLQSLGAEIA

SEQ ID NO: 199591 - protein, 10 aa, Mycobacterium tuberculosis
LQSLGAEIAV

SEQ ID NO: 199592 - protein, 10 aa, Mycobacterium tuberculosis
SLGAEIAVEQ

SEQ ID NO: 199593 - protein, 10 aa, Mycobacterium tuberculosis
AEIAVEQAAL

SEQ ID NO: 199594 - protein, 10 aa, Mycobacterium tuberculosis
QSAWQGDTGI

SEQ ID NO: 199595 - protein, 10 aa, Mycobacterium tuberculosis
SAWQGDTGIT

SEQ ID NO: 199596 - protein, 10 aa, Mycobacterium tuberculosis
WQGDTGITYQ

SEQ ID NO: 199597 - protein, 10 aa, Mycobacterium tuberculosis
ITYQAWQAQW

SEQ ID NO: 199598 - protein, 10 aa, Mycobacterium tuberculosis
YQAWQAQWNQ

SEQ ID NO: 199599 - protein, 10 aa, Mycobacterium tuberculosis
QAWQAQWNQA

SEQ ID NO: 199600 - protein, 10 aa, Mycobacterium tuberculosis
WQAQWNQAME

SEQ ID NO: 199601 - protein, 10 aa, Mycobacterium tuberculosis
AQWNQAMEDL

SEQ ID NO: 199602 - protein, 10 aa, Mycobacterium tuberculosis
NQAMEDLVRA

SEQ ID NO: 199603 - protein, 10 aa, Mycobacterium tuberculosis
QAMEDLVRAY

SEQ ID NO: 199604 - protein, 10 aa, Mycobacterium tuberculosis
MSSTHEANTM

SEQ ID NO: 199605 - protein, 10 aa, Mycobacterium tuberculosis
STHEANTMAM

SEQ ID NO: 199606 - protein, 10 aa, Mycobacterium tuberculosis
EANTMAMMAR

SEQ ID NO: 199607 - protein, 10 aa, Mycobacterium tuberculosis
TMAMMARDTA

SEQ ID NO: 199608 - protein, 10 aa, Mycobacterium tuberculosis
AMMARDTAEA

SEQ ID NO: 199609 - protein, 10 aa, Mycobacterium tuberculosis
MMARDTAEAA

SEQ ID NO: 199610 - protein, 10 aa, Mycobacterium tuberculosis
MARDTAEAAK

SEQ ID NO: 199611 - protein, 11 aa, Mycobacterium tuberculosis
MSQIMYNYPAM

SEQ ID NO: 199612 - protein, 11 aa, Mycobacterium tuberculosis
SQIMYNYPAML

SEQ ID NO: 199613 - protein, 11 aa, Mycobacterium tuberculosis
IMYNYPAMLGH

SEQ ID NO: 199614 - protein, 11 aa, Mycobacterium tuberculosis
YPAMLGHAGDM

SEQ ID NO: 199615 - protein, 11 aa, Mycobacterium tuberculosis
MLGHAGDMAGY

SEQ ID NO: 199616 - protein, 11 aa, Mycobacterium tuberculosis
MAGYAGTLQSL

SEQ ID NO: 199617 - protein, 11 aa, Mycobacterium tuberculosis
TLQSLGAEIAV

SEQ ID NO: 199618 - protein, 11 aa, Mycobacterium tuberculosis
SLGAEIAVEQA

SEQ ID NO: 199619 - protein, 11 aa, Mycobacterium tuberculosis
AEIAVEQAALQ

SEQ ID NO: 199620 - protein, 11 aa, Mycobacterium tuberculosis
IAVEQAALQSA

SEQ ID NO: 199621 - protein, 11 aa, Mycobacterium tuberculosis
LQSAWQGDTGI

SEQ ID NO: 199622 - protein, 11 aa, Mycobacterium tuberculosis
SAWQGDTGITY

SEQ ID NO: 199623 - protein, 11 aa, Mycobacterium tuberculosis
WQGDTGITYQA

SEQ ID NO: 199624 - protein, 11 aa, Mycobacterium tuberculosis
DTGITYQAWQA

SEQ ID NO: 199625 - protein, 11 aa, Mycobacterium tuberculosis
GITYQAWQAQW

SEQ ID NO: 199626 - protein, 11 aa, Mycobacterium tuberculosis
YQAWQAQWNQA

SEQ ID NO: 199627 - protein, 11 aa, Mycobacterium tuberculosis
QAWQAQWNQAM

SEQ ID NO: 199628 - protein, 11 aa, Mycobacterium tuberculosis
AQWNQAMEDLV

SEQ ID NO: 199629 - protein, 11 aa, Mycobacterium tuberculosis
NQAMEDLVRAY

SEQ ID NO: 199630 - protein, 11 aa, Mycobacterium tuberculosis
AMEDLVRAYHA

SEQ ID NO: 199631 - protein, 11 aa, Mycobacterium tuberculosis
MEDLVRAYHAM

SEQ ID NO: 199632 - protein, 11 aa, Mycobacterium tuberculosis
LVRAYHAMSST

SEQ ID NO: 199633 - protein, 11 aa, Mycobacterium tuberculosis
AMSSTHEANTM

SEQ ID NO: 199634 - protein, 11 aa, Mycobacterium tuberculosis
STHEANTMAMM

SEQ ID NO: 199635 - protein, 11 aa, Mycobacterium tuberculosis
HEANTMAMMAR

SEQ ID NO: 199636 - protein, 11 aa, Mycobacterium tuberculosis
NTMAMMARDTA

SEQ ID NO: 199637 - protein, 11 aa, Mycobacterium tuberculosis
MAMMARDTAEA

SEQ ID NO: 199638 - protein, 11 aa, Mycobacterium tuberculosis
AMMARDTAEAA

SEQ ID NO: 199639 - protein, 11 aa, Mycobacterium tuberculosis
MMARDTAEAAK

SEQ ID NO: 199640 - protein, 11 aa, Mycobacterium tuberculosis
MARDTAEAAKW

SEQ ID NO: 199641 - protein, 94 aa, Mycobacterium tuberculosis; identical to SEQ ID NO: 27

SEQ ID NO: 199642 - protein, 8 aa, Mycobacterium tuberculosis
YQFGDVDA

SEQ ID NO: 199643 - protein, 8 aa, Mycobacterium tuberculosis
DVDAHGAM

SEQ ID NO: 199644 - protein, 8 aa, Mycobacterium tuberculosis
DAHGAMIR

SEQ ID NO: 199645 - protein, 8 aa, Mycobacterium tuberculosis
AMIRAQAA

SEQ ID NO: 199646 - protein, 8 aa, Mycobacterium tuberculosis
IRAQAASL

SEQ ID NO: 199647 - protein, 8 aa, Mycobacterium tuberculosis
AQAASLEA

SEQ ID NO: 199648 - protein, 8 aa, Mycobacterium tuberculosis
SLEAEHQA

SEQ ID NO: 199649 - protein, 8 aa, Mycobacterium tuberculosis
LEAEHQAI

SEQ ID NO: 199650 - protein, 8 aa, Mycobacterium tuberculosis
IVRDVLAA

SEQ ID NO: 199651 - protein, 8 aa, Mycobacterium tuberculosis
VLAAGDFW

SEQ ID NO: 199652 - protein, 8 aa, Mycobacterium tuberculosis
GSVACQEF

SEQ ID NO: 199653 - protein, 8 aa, Mycobacterium tuberculosis
SVACQEFI

SEQ ID NO: 199654 - protein, 8 aa, Mycobacterium tuberculosis
EFITQLGR

SEQ ID NO: 199655 - protein, 8 aa, Mycobacterium tuberculosis
ITQLGRNF

SEQ ID NO: 199656 - protein, 8 aa, Mycobacterium tuberculosis
QLGRNFQV

SEQ ID NO: 199657 - protein, 8 aa, Mycobacterium tuberculosis
GRNFQVIY

SEQ ID NO: 199658 - protein, 8 aa, Mycobacterium tuberculosis
FQVIYEQA

SEQ ID NO: 199659 - protein, 8 aa, Mycobacterium tuberculosis
VIYEQANA

SEQ ID NO: 199660 - protein, 8 aa, Mycobacterium tuberculosis
QANAHGQK

SEQ ID NO: 199661 - protein, 8 aa, Mycobacterium tuberculosis
VQAAGNNM

SEQ ID NO: 199662 - protein, 8 aa, Mycobacterium tuberculosis
QAAGNNMA

SEQ ID NO: 199663 - protein, 8 aa, Mycobacterium tuberculosis
NMAQTDSA

SEQ ID NO: 199664 - protein, 8 aa, Mycobacterium tuberculosis
MAQTDSAV

SEQ ID NO: 199665 - protein, 8 aa, Mycobacterium tuberculosis
DSAVGSSW

SEQ ID NO: 199666 - protein, 8 aa, Mycobacterium tuberculosis
SAVGSSWA

SEQ ID NO: 199667 - protein, 9 aa, Mycobacterium tuberculosis
MTINYQFGD

SEQ ID NO: 199668 - protein, 9 aa, Mycobacterium tuberculosis
TINYQFGDV

SEQ ID NO: 199669 - protein, 9 aa, Mycobacterium tuberculosis
YQFGDVDAH

SEQ ID NO: 199670 - protein, 9 aa, Mycobacterium tuberculosis
DVDAHGAMI

SEQ ID NO: 199671 - protein, 9 aa, Mycobacterium tuberculosis
HGAMIRAQA

SEQ ID NO: 199672 - protein, 9 aa, Mycobacterium tuberculosis
MIRAQAASL

SEQ ID NO: 199673 - protein, 9 aa, Mycobacterium tuberculosis
RAQAASLEA

SEQ ID NO: 199674 - protein, 9 aa, Mycobacterium tuberculosis
AQAASLEAE

SEQ ID NO: 199675 - protein, 9 aa, Mycobacterium tuberculosis
SLEAEHQAI

SEQ ID NO: 199676 - protein, 9 aa, Mycobacterium tuberculosis
EAEHQAIVR

SEQ ID NO: 199677 - protein, 9 aa, Mycobacterium tuberculosis
HQAIVRDVL

SEQ ID NO: 199678 - protein, 9 aa, Mycobacterium tuberculosis
VLAAGDFWG

SEQ ID NO: 199679 - protein, 9 aa, Mycobacterium tuberculosis
DFWGGAGSV

SEQ ID NO: 199680 - protein, 9 aa, Mycobacterium tuberculosis
TQLGRNFQV

SEQ ID NO: 199681 - protein, 9 aa, Mycobacterium tuberculosis
QLGRNFQVI

SEQ ID NO: 199682 - protein, 9 aa, Mycobacterium tuberculosis
QVIYEQANA

SEQ ID NO: 199683 - protein, 9 aa, Mycobacterium tuberculosis
EQANAHGQK

SEQ ID NO: 199684 - protein, 9 aa, Mycobacterium tuberculosis
QANAHGQKV

SEQ ID NO: 199685 - protein, 9 aa, Mycobacterium tuberculosis
VQAAGNNMA

SEQ ID NO: 199686 - protein, 9 aa, Mycobacterium tuberculosis
NNMAQTDSA

SEQ ID NO: 199687 - protein, 9 aa, Mycobacterium tuberculosis
NMAQTDSAV

SEQ ID NO: 199688 - protein, 9 aa, Mycobacterium tuberculosis
AQTDSAVGS

SEQ ID NO: 199689 - protein, 10 aa, Mycobacterium tuberculosis
MTINYQFGDV

SEQ ID NO: 199690 - protein, 10 aa, Mycobacterium tuberculosis
DVDAHGAMIR

SEQ ID NO: 199691 - protein, 10 aa, Mycobacterium tuberculosis
HGAMIRAQAA

SEQ ID NO: 199692 - protein, 10 aa, Mycobacterium tuberculosis
AMIRAQAASL

SEQ ID NO: 199693 - protein, 10 aa, Mycobacterium tuberculosis
AQAASLEAEH

SEQ ID NO: 199694 - protein, 10 aa, Mycobacterium tuberculosis
SLEAEHQAIV

SEQ ID NO: 199695 - protein, 10 aa, Mycobacterium tuberculosis
AEHQAIVRDV

SEQ ID NO: 199696 - protein, 10 aa, Mycobacterium tuberculosis
EHQAIVRDVL

SEQ ID NO: 199697 - protein, 10 aa, Mycobacterium tuberculosis
VLAAGDFWGG

SEQ ID NO: 199698 - protein, 10 aa, Mycobacterium tuberculosis
LAAGDFWGGA

SEQ ID NO: 199699 - protein, 10 aa, Mycobacterium tuberculosis
EFITQLGRNF

SEQ ID NO: 199700 - protein, 10 aa, Mycobacterium tuberculosis
ITQLGRNFQV

SEQ ID NO: 199701 - protein, 10 aa, Mycobacterium tuberculosis
TQLGRNFQVI

SEQ ID NO: 199702 - protein, 10 aa, Mycobacterium tuberculosis
QLGRNFQVIY

SEQ ID NO: 199703 - protein, 10 aa, Mycobacterium tuberculosis
FQVIYEQANA

SEQ ID NO: 199704 - protein, 10 aa, Mycobacterium tuberculosis
QVIYEQANAH

SEQ ID NO: 199705 - protein, 10 aa, Mycobacterium tuberculosis
VQAAGNNMAQ

SEQ ID NO: 199706 - protein, 10 aa, Mycobacterium tuberculosis
NNMAQTDSAV

SEQ ID NO: 199707 - protein, 10 aa, Mycobacterium tuberculosis
QTDSAVGSSW

SEQ ID NO: 199708 - protein, 11 aa, Mycobacterium tuberculosis
YQFGDVDAHGA

SEQ ID NO: 199709 - protein, 11 aa, Mycobacterium tuberculosis
DVDAHGAMIRA

SEQ ID NO: 199710 - protein, 11 aa, Mycobacterium tuberculosis
GAMIRAQAASL

SEQ ID NO: 199711 - protein, 11 aa, Mycobacterium tuberculosis
MIRAQAASLEA

SEQ ID NO: 199712 - protein, 11 aa, Mycobacterium tuberculosis
ASLEAEHQAIV

SEQ ID NO: 199713 - protein, 11 aa, Mycobacterium tuberculosis
AEHQAIVRDVL

SEQ ID NO: 199714 - protein, 11 aa, Mycobacterium tuberculosis
HQAIVRDVLAA

SEQ ID NO: 199715 - protein, 11 aa, Mycobacterium tuberculosis
IVRDVLAAGDF

SEQ ID NO: 199716 - protein, 11 aa, Mycobacterium tuberculosis
VLAAGDFWGGA

SEQ ID NO: 199717 - protein, 11 aa, Mycobacterium tuberculosis
SVACQEFITQL

SEQ ID NO: 199718 - protein, 11 aa, Mycobacterium tuberculosis
QEFITQLGRNF

SEQ ID NO: 199719 - protein, 11 aa, Mycobacterium tuberculosis
FITQLGRNFQV

SEQ ID NO: 199720 - protein, 11 aa, Mycobacterium tuberculosis
TQLGRNFQVIY

SEQ ID NO: 199721 - protein, 11 aa, Mycobacterium tuberculosis
FQVIYEQANAH

SEQ ID NO: 199722 - protein, 11 aa, Mycobacterium tuberculosis
VIYEQANAHGQ

SEQ ID NO: 199723 - protein, 11 aa, Mycobacterium tuberculosis
IYEQANAHGQK

SEQ ID NO: 199724 - protein, 11 aa, Mycobacterium tuberculosis
YEQANAHGQKV

SEQ ID NO: 199725 - protein, 11 aa, Mycobacterium tuberculosis
GQKVQAAGNNM

SEQ ID NO: 199726 - protein, 11 aa, Mycobacterium tuberculosis
VQAAGNNMAQT

SEQ ID NO: 199727 - protein, 11 aa, Mycobacterium tuberculosis
AQTDSAVGSSW

SEQ ID NO: 199728 - protein, 95 aa, Mycobacterium tuberculosis; identical to SEQ ID NO: 73

SEQ ID NO: 199729 - protein, 8 aa, Mycobacterium tuberculosis
MTEQQWNF

SEQ ID NO: 199730 - protein, 8 aa, Mycobacterium tuberculosis
QQWNFAGI

SEQ ID NO: 199731 - protein, 8 aa, Mycobacterium tuberculosis
IQGNVTSI

SEQ ID NO: 199732 - protein, 8 aa, Mycobacterium tuberculosis
NVTSIHSL

SEQ ID NO: 199733 - protein, 8 aa, Mycobacterium tuberculosis
HSLLDEGK

SEQ ID NO: 199734 - protein, 8 aa, Mycobacterium tuberculosis
SLLDEGKQ

SEQ ID NO: 199735 - protein, 8 aa, Mycobacterium tuberculosis
LLDEGKQS

SEQ ID NO: 199736 - protein, 8 aa, Mycobacterium tuberculosis
KQSLTKLA

SEQ ID NO: 199737 - protein, 8 aa, Mycobacterium tuberculosis
SLTKLAAA

SEQ ID NO: 199738 - protein, 8 aa, Mycobacterium tuberculosis
LTKLAAAW

SEQ ID NO: 199739 - protein, 8 aa, Mycobacterium tuberculosis
AYQGVQQK

SEQ ID NO: 199740 - protein, 8 aa, Mycobacterium tuberculosis
NALQNLAR

SEQ ID NO: 199741 - protein, 8 aa, Mycobacterium tuberculosis
ALQNLART

SEQ ID NO: 199742 - protein, 8 aa, Mycobacterium tuberculosis
LQNLARTI

SEQ ID NO: 199743 - protein, 8 aa, Mycobacterium tuberculosis
ISEAGQAM

SEQ ID NO: 199744 - protein, 8 aa, Mycobacterium tuberculosis
MASTEGNV

SEQ ID NO: 199745 - protein, 9 aa, Mycobacterium tuberculosis
MTEQQWNFA

SEQ ID NO: 199746 - protein, 9 aa, Mycobacterium tuberculosis
EQQWNFAGI

SEQ ID NO: 199747 - protein, 9 aa, Mycobacterium tuberculosis
AASAIQGNV

SEQ ID NO: 199748 - protein, 9 aa, Mycobacterium tuberculosis
AIQGNVTSI

SEQ ID NO: 199749 - protein, 9 aa, Mycobacterium tuberculosis
NVTSIHSLL

SEQ ID NO: 199750 - protein, 9 aa, Mycobacterium tuberculosis
SLLDEGKQS

SEQ ID NO: 199751 - protein, 9 aa, Mycobacterium tuberculosis
LLDEGKQSL

SEQ ID NO: 199752 - protein, 9 aa, Mycobacterium tuberculosis
KQSLTKLAA

SEQ ID NO: 199753 - protein, 9 aa, Mycobacterium tuberculosis
KLAAAWGGS

SEQ ID NO: 199754 - protein, 9 aa, Mycobacterium tuberculosis
WGGSGSEAY

SEQ ID NO: 199755 - protein, 9 aa, Mycobacterium tuberculosis
SGSEAYQGV

SEQ ID NO: 199756 - protein, 9 aa, Mycobacterium tuberculosis
EAYQGVQQK

SEQ ID NO: 199757 - protein, 9 aa, Mycobacterium tuberculosis
AYQGVQQKW

SEQ ID NO: 199758 - protein, 9 aa, Mycobacterium tuberculosis
VQQKWDATA

SEQ ID NO: 199759 - protein, 9 aa, Mycobacterium tuberculosis
ATATELNNA

SEQ ID NO: 199760 - protein, 9 aa, Mycobacterium tuberculosis
TATELNNAL

SEQ ID NO: 199761 - protein, 9 aa, Mycobacterium tuberculosis
ELNNALQNL

SEQ ID NO: 199762 - protein, 9 aa, Mycobacterium tuberculosis
NNALQNLAR

SEQ ID NO: 199763 - protein, 9 aa, Mycobacterium tuberculosis
ALQNLARTI

SEQ ID NO: 199764 - protein, 9 aa, Mycobacterium tuberculosis
NLARTISEA

SEQ ID NO: 199765 - protein, 9 aa, Mycobacterium tuberculosis
TISEAGQAM

SEQ ID NO: 199766 - protein, 9 aa, Mycobacterium tuberculosis
AMASTEGNV

SEQ ID NO: 199767 - protein, 9 aa, Mycobacterium tuberculosis
MASTEGNVT

SEQ ID NO: 199768 - protein, 9 aa, Mycobacterium tuberculosis
STEGNVTGM

SEQ ID NO: 199769 - protein, 9 aa, Mycobacterium tuberculosis
TEGNVTGMF

SEQ ID NO: 199770 - protein, 10 aa, Mycobacterium tuberculosis
QQWNFAGIEA

SEQ ID NO: 199771 - protein, 10 aa, Mycobacterium tuberculosis
FAGIEAAASA

SEQ ID NO: 199772 - protein, 10 aa, Mycobacterium tuberculosis
AAASAIQGNV

SEQ ID NO: 199773 - protein, 10 aa, Mycobacterium tuberculosis
SAIQGNVTSI

SEQ ID NO: 199774 - protein, 10 aa, Mycobacterium tuberculosis
SIHSLLDEGK

SEQ ID NO: 199775 - protein, 10 aa, Mycobacterium tuberculosis
SLLDEGKQSL

SEQ ID NO: 199776 - protein, 10 aa, Mycobacterium tuberculosis
LLDEGKQSLT

SEQ ID NO: 199777 - protein, 10 aa, Mycobacterium tuberculosis
KQSLTKLAAA

SEQ ID NO: 199778 - protein, 10 aa, Mycobacterium tuberculosis
QSLTKLAAAW

SEQ ID NO: 199779 - protein, 10 aa, Mycobacterium tuberculosis
AAWGGSGSEA

SEQ ID NO: 199780 - protein, 10 aa, Mycobacterium tuberculosis
EAYQGVQQKW

SEQ ID NO: 199781 - protein, 10 aa, Mycobacterium tuberculosis
VQQKWDATAT

SEQ ID NO: 199782 - protein, 10 aa, Mycobacterium tuberculosis
QKWDATATEL

SEQ ID NO: 199783 - protein, 10 aa, Mycobacterium tuberculosis
ATATELNNAL

SEQ ID NO: 199784 - protein, 10 aa, Mycobacterium tuberculosis
TELNNALQNL

SEQ ID NO: 199785 - protein, 10 aa, Mycobacterium tuberculosis
ELNNALQNLA

SEQ ID NO: 199786 - protein, 10 aa, Mycobacterium tuberculosis
NALQNLARTI

SEQ ID NO: 199787 - protein, 10 aa, Mycobacterium tuberculosis
RTISEAGQAM

SEQ ID NO: 199788 - protein, 10 aa, Mycobacterium tuberculosis
TISEAGQAMA

SEQ ID NO: 199789 - protein, 10 aa, Mycobacterium tuberculosis
QAMASTEGNV

SEQ ID NO: 199790 - protein, 10 aa, Mycobacterium tuberculosis
STEGNVTGMF

SEQ ID NO: 199791 - protein, 11 aa, Mycobacterium tuberculosis
MTEQQWNFAGI

SEQ ID NO: 199792 - protein, 11 aa, Mycobacterium tuberculosis
QQWNFAGIEAA

SEQ ID NO: 199793 - protein, 11 aa, Mycobacterium tuberculosis
FAGIEAAASAI

SEQ ID NO: 199794 - protein, 11 aa, Mycobacterium tuberculosis
EAAASAIQGNV

SEQ ID NO: 199795 - protein, 11 aa, Mycobacterium tuberculosis
IQGNVTSIHSL

SEQ ID NO: 199796 - protein, 11 aa, Mycobacterium tuberculosis
TSIHSLLDEGK

SEQ ID NO: 199797 - protein, 11 aa, Mycobacterium tuberculosis
SLLDEGKQSLT

SEQ ID NO: 199798 - protein, 11 aa, Mycobacterium tuberculosis
LLDEGKQSLTK

SEQ ID NO: 199799 - protein, 11 aa, Mycobacterium tuberculosis
KQSLTKLAAAW

SEQ ID NO: 199800 - protein, 11 aa, Mycobacterium tuberculosis
KLAAAWGGSGS

SEQ ID NO: 199801 - protein, 11 aa, Mycobacterium tuberculosis
AAAWGGSGSEA

SEQ ID NO: 199802 - protein, 11 aa, Mycobacterium tuberculosis
AAWGGSGSEAY

SEQ ID NO: 199803 - protein, 11 aa, Mycobacterium tuberculosis
GSEAYQGVQQK

SEQ ID NO: 199804 - protein, 11 aa, Mycobacterium tuberculosis
SEAYQGVQQKW

SEQ ID NO: 199805 - protein, 11 aa, Mycobacterium tuberculosis
QQKWDATATEL

SEQ ID NO: 199806 - protein, 11 aa, Mycobacterium tuberculosis
DATATELNNAL

SEQ ID NO: 199807 - protein, 11 aa, Mycobacterium tuberculosis
ELNNALQNLAR

SEQ ID NO: 199808 - protein, 11 aa, Mycobacterium tuberculosis
LQNLARTISEA

SEQ ID NO: 199809 - protein, 11 aa, Mycobacterium tuberculosis
GQAMASTEGNV

SEQ ID NO: 199810 - protein, 11 aa, Mycobacterium tuberculosis
MASTEGNVTGM

SEQ ID NO: 199811 - protein, 325 aa, Mycobacterium tuberculosis; identical to SEQ ID NO: 82

SEQ ID NO: 199812 - protein, 8 aa, Mycobacterium tuberculosis
KIRAWGRR

SEQ ID NO: 199813 - protein, 8 aa, Mycobacterium tuberculosis
RAWGRRLM

SEQ ID NO: 199814 - protein, 8 aa, Mycobacterium tuberculosis
AWGRRLMI

SEQ ID NO: 199815 - protein, 8 aa, Mycobacterium tuberculosis
RRLMIGTA

SEQ ID NO: 199816 - protein, 8 aa, Mycobacterium tuberculosis
RLMIGTAA

SEQ ID NO: 199817 - protein, 8 aa, Mycobacterium tuberculosis
LMIGTAAA

SEQ ID NO: 199818 - protein, 8 aa, Mycobacterium tuberculosis
MIGTAAAV

SEQ ID NO: 199819 - protein, 8 aa, Mycobacterium tuberculosis
GTAAAVVL

SEQ ID NO: 199820 - protein, 8 aa, Mycobacterium tuberculosis
AAVVLPGL

SEQ ID NO: 199821 - protein, 8 aa, Mycobacterium tuberculosis
AVVLPGLV

SEQ ID NO: 199822 - protein, 8 aa, Mycobacterium tuberculosis
VLPGLVGL

SEQ ID NO: 199823 - protein, 8 aa, Mycobacterium tuberculosis
LPGLVGLA

SEQ ID NO: 199824 - protein, 8 aa, Mycobacterium tuberculosis
GLAGGAAT

SEQ ID NO: 199825 - protein, 8 aa, Mycobacterium tuberculosis
GAATAGAF

SEQ ID NO: 199826 - protein, 8 aa, Mycobacterium tuberculosis
ATAGAFSR

SEQ ID NO: 199827 - protein, 8 aa, Mycobacterium tuberculosis
FSRPGLPV

SEQ ID NO: 199828 - protein, 8 aa, Mycobacterium tuberculosis
RPGLPVEY

SEQ ID NO: 199829 - protein, 8 aa, Mycobacterium tuberculosis
GLPVEYLQ

SEQ ID NO: 199830 - protein, 8 aa, Mycobacterium tuberculosis
LPVEYLQV

SEQ ID NO: 199831 - protein, 8 aa, Mycobacterium tuberculosis
LQVPSPSM

SEQ ID NO: 199832 - protein, 8 aa, Mycobacterium tuberculosis
SPSMGRDI

SEQ ID NO: 199833 - protein, 8 aa, Mycobacterium tuberculosis
PSMGRDIK

SEQ ID NO: 199834 - protein, 8 aa, Mycobacterium tuberculosis
SMGRDIKV

SEQ ID NO: 199835 - protein, 8 aa, Mycobacterium tuberculosis
FQSGGNNS

SEQ ID NO: 199836 - protein, 8 aa, Mycobacterium tuberculosis
NSPAVYLL

SEQ ID NO: 199837 - protein, 8 aa, Mycobacterium tuberculosis
AVYLLDGL

SEQ ID NO: 199838 - protein, 8 aa, Mycobacterium tuberculosis
VYLLDGLR

SEQ ID NO: 199839 - protein, 8 aa, Mycobacterium tuberculosis
YLLDGLRA

SEQ ID NO: 199840 - protein, 8 aa, Mycobacterium tuberculosis
LLDGLRAQ

SEQ ID NO: 199841 - protein, 8 aa, Mycobacterium tuberculosis
WDINTPAF

SEQ ID NO: 199842 - protein, 8 aa, Mycobacterium tuberculosis
INTPAFEW

SEQ ID NO: 199843 - protein, 8 aa, Mycobacterium tuberculosis
NTPAFEWY

SEQ ID NO: 199844 - protein, 8 aa, Mycobacterium tuberculosis
TPAFEWYY

SEQ ID NO: 199845 - protein, 8 aa, Mycobacterium tuberculosis
YYQSGLSI

SEQ ID NO: 199846 - protein, 8 aa, Mycobacterium tuberculosis
YQSGLSIV

SEQ ID NO: 199847 - protein, 8 aa, Mycobacterium tuberculosis
GLSIVMPV

SEQ ID NO: 199848 - protein, 8 aa, Mycobacterium tuberculosis
MPVGGQSS

SEQ ID NO: 199849 - protein, 8 aa, Mycobacterium tuberculosis
QSSFYSDW

SEQ ID NO: 199850 - protein, 8 aa, Mycobacterium tuberculosis
SSFYSDWY

SEQ ID NO: 199851 - protein, 8 aa, Mycobacterium tuberculosis
YSDWYSPA

SEQ ID NO: 199852 - protein, 8 aa, Mycobacterium tuberculosis
WYSPACGK

SEQ ID NO: 199853 - protein, 8 aa, Mycobacterium tuberculosis
KAGCQTYK

SEQ ID NO: 199854 - protein, 8 aa, Mycobacterium tuberculosis
QTYKWETF

SEQ ID NO: 199855 - protein, 8 aa, Mycobacterium tuberculosis
TYKWETFL

SEQ ID NO: 199856 - protein, 8 aa, Mycobacterium tuberculosis
ETFLTSEL

SEQ ID NO: 199857 - protein, 8 aa, Mycobacterium tuberculosis
FLTSELPQ

SEQ ID NO: 199858 - protein, 8 aa, Mycobacterium tuberculosis
LTSELPQW

SEQ ID NO: 199859 - protein, 8 aa, Mycobacterium tuberculosis
SELPQWLS

SEQ ID NO: 199860 - protein, 8 aa, Mycobacterium tuberculosis
ELPQWLSA

SEQ ID NO: 199861 - protein, 8 aa, Mycobacterium tuberculosis
LPQWLSAN

SEQ ID NO: 199862 - protein, 8 aa, Mycobacterium tuberculosis
PQWLSANR

SEQ ID NO: 199863 - protein, 8 aa, Mycobacterium tuberculosis
WLSANRAV

SEQ ID NO: 199864 - protein, 8 aa, Mycobacterium tuberculosis
LSANRAVK

SEQ ID NO: 199865 - protein, 8 aa, Mycobacterium tuberculosis
AVKPTGSA

SEQ ID NO: 199866 - protein, 8 aa, Mycobacterium tuberculosis
KPTGSAAI

SEQ ID NO: 199867 - protein, 8 aa, Mycobacterium tuberculosis
TGSAAIGL

SEQ ID NO: 199868 - protein, 8 aa, Mycobacterium tuberculosis
SAAIGLSM

SEQ ID NO: 199869 - protein, 8 aa, Mycobacterium tuberculosis
AAIGLSMA

SEQ ID NO: 199870 - protein, 8 aa, Mycobacterium tuberculosis
SMAGSSAM

SEQ ID NO: 199871 - protein, 8 aa, Mycobacterium tuberculosis
MAGSSAMI

SEQ ID NO: 199872 - protein, 8 aa, Mycobacterium tuberculosis
SSAMILAA

SEQ ID NO: 199873 - protein, 8 aa, Mycobacterium tuberculosis
SAMILAAY

SEQ ID NO: 199874 - protein, 8 aa, Mycobacterium tuberculosis
ILAAYHPQ

SEQ ID NO: 199875 - protein, 8 aa, Mycobacterium tuberculosis
AYHPQQFI

SEQ ID NO: 199876 - protein, 8 aa, Mycobacterium tuberculosis
YHPQQFIY

SEQ ID NO: 199877 - protein, 8 aa, Mycobacterium tuberculosis
HPQQFIYA

SEQ ID NO: 199878 - protein, 8 aa, Mycobacterium tuberculosis
YAGSLSAL

SEQ ID NO: 199879 - protein, 8 aa, Mycobacterium tuberculosis
ALLDPSQG

SEQ ID NO: 199880 - protein, 8 aa, Mycobacterium tuberculosis
LLDPSQGM

SEQ ID NO: 199881 - protein, 8 aa, Mycobacterium tuberculosis
SQGMGPSL

SEQ ID NO: 199882 - protein, 8 aa, Mycobacterium tuberculosis
QGMGPSLI

SEQ ID NO: 199883 - protein, 8 aa, Mycobacterium tuberculosis
MGPSLIGL

SEQ ID NO: 199884 - protein, 8 aa, Mycobacterium tuberculosis
GPSLIGLA

SEQ ID NO: 199885 - protein, 8 aa, Mycobacterium tuberculosis
SLIGLAMG

SEQ ID NO: 199886 - protein, 8 aa, Mycobacterium tuberculosis
AMGDAGGY

SEQ ID NO: 199887 - protein, 8 aa, Mycobacterium tuberculosis
GYKAADMW

SEQ ID NO: 199888 - protein, 8 aa, Mycobacterium tuberculosis
GPSSDPAW

SEQ ID NO: 199889 - protein, 8 aa, Mycobacterium tuberculosis
SSDPAWER

SEQ ID NO: 199890 - protein, 8 aa, Mycobacterium tuberculosis
QQIPKLVA

SEQ ID NO: 199891 - protein, 8 aa, Mycobacterium tuberculosis
KLVANNTR

SEQ ID NO: 199892 - protein, 8 aa, Mycobacterium tuberculosis
LVANNTRL

SEQ ID NO: 199893 - protein, 8 aa, Mycobacterium tuberculosis
VANNTRLW

SEQ ID NO: 199894 - protein, 8 aa, Mycobacterium tuberculosis
WVYCGNGT

SEQ ID NO: 199895 - protein, 8 aa, Mycobacterium tuberculosis
TPNELGGA

SEQ ID NO: 199896 - protein, 8 aa, Mycobacterium tuberculosis
NELGGANI

SEQ ID NO: 199897 - protein, 8 aa, Mycobacterium tuberculosis
AEFLENFV

SEQ ID NO: 199898 - protein, 8 aa, Mycobacterium tuberculosis
EFLENFVR

SEQ ID NO: 199899 - protein, 8 aa, Mycobacterium tuberculosis
NFVRSSNL

SEQ ID NO: 199900 - protein, 8 aa, Mycobacterium tuberculosis
FVRSSNLK

SEQ ID NO: 199901 - protein, 8 aa, Mycobacterium tuberculosis
NLKFQDAY

SEQ ID NO: 199902 - protein, 8 aa, Mycobacterium tuberculosis
FQDAYNAA

SEQ ID NO: 199903 - protein, 8 aa, Mycobacterium tuberculosis
NAAGGHNA

SEQ ID NO: 199904 - protein, 8 aa, Mycobacterium tuberculosis
AAGGHNAV

SEQ ID NO: 199905 - protein, 8 aa, Mycobacterium tuberculosis
GHNAVFNF

SEQ ID NO: 199906 - protein, 8 aa, Mycobacterium tuberculosis
FPPNGTHS

SEQ ID NO: 199907 - protein, 8 aa, Mycobacterium tuberculosis
PPNGTHSW

SEQ ID NO: 199908 - protein, 8 aa, Mycobacterium tuberculosis
GTHSWEYW

SEQ ID NO: 199909 - protein, 8 aa, Mycobacterium tuberculosis
HSWEYWGA

SEQ ID NO: 199910 - protein, 8 aa, Mycobacterium tuberculosis
WEYWGAQL

SEQ ID NO: 199911 - protein, 8 aa, Mycobacterium tuberculosis
WGAQLNAM

SEQ ID NO: 199912 - protein, 8 aa, Mycobacterium tuberculosis
GAQLNAMK

SEQ ID NO: 199913 - protein, 9 aa, Mycobacterium tuberculosis
MTDVSRKIR

SEQ ID NO: 199914 - protein, 9 aa, Mycobacterium tuberculosis
DVSRKIRAW

SEQ ID NO: 199915 - protein, 9 aa, Mycobacterium tuberculosis
KIRAWGRRL

SEQ ID NO: 199916 - protein, 9 aa, Mycobacterium tuberculosis
RAWGRRLMI

SEQ ID NO: 199917 - protein, 9 aa, Mycobacterium tuberculosis
RRLMIGTAA

SEQ ID NO: 199918 - protein, 9 aa, Mycobacterium tuberculosis
RLMIGTAAA

SEQ ID NO: 199919 - protein, 9 aa, Mycobacterium tuberculosis
LMIGTAAAV

SEQ ID NO: 199920 - protein, 9 aa, Mycobacterium tuberculosis
MIGTAAAVV

SEQ ID NO: 199921 - protein, 9 aa, Mycobacterium tuberculosis
AAAVVLPGL

SEQ ID NO: 199922 - protein, 9 aa, Mycobacterium tuberculosis
AAVVLPGLV

SEQ ID NO: 199923 - protein, 9 aa, Mycobacterium tuberculosis
VVLPGLVGL

SEQ ID NO: 199924 - protein, 9 aa, Mycobacterium tuberculosis
VLPGLVGLA

SEQ ID NO: 199925 - protein, 9 aa, Mycobacterium tuberculosis
LPGLVGLAG

SEQ ID NO: 199926 - protein, 9 aa, Mycobacterium tuberculosis
GLVGLAGGA

SEQ ID NO: 199927 - protein, 9 aa, Mycobacterium tuberculosis
GLAGGAATA

SEQ ID NO: 199928 - protein, 9 aa, Mycobacterium tuberculosis
GGAATAGAF

SEQ ID NO: 199929 - protein, 9 aa, Mycobacterium tuberculosis
AATAGAFSR

SEQ ID NO: 199930 - protein, 9 aa, Mycobacterium tuberculosis
RPGLPVEYL

SEQ ID NO: 199931 - protein, 9 aa, Mycobacterium tuberculosis
GLPVEYLQV

SEQ ID NO: 199932 - protein, 9 aa, Mycobacterium tuberculosis
LPVEYLQVP

SEQ ID NO: 199933 - protein, 9 aa, Mycobacterium tuberculosis
YLQVPSPSM

SEQ ID NO: 199934 - protein, 9 aa, Mycobacterium tuberculosis
QVPSPSMGR

SEQ ID NO: 199935 - protein, 9 aa, Mycobacterium tuberculosis
FQSGGNNSP

SEQ ID NO: 199936 - protein, 9 aa, Mycobacterium tuberculosis
AVYLLDGLR

SEQ ID NO: 199937 - protein, 9 aa, Mycobacterium tuberculosis
YLLDGLRAQ

SEQ ID NO: 199938 - protein, 9 aa, Mycobacterium tuberculosis
LLDGLRAQD

SEQ ID NO: 199939 - protein, 9 aa, Mycobacterium tuberculosis
RAQDDYNGW

SEQ ID NO: 199940 - protein, 9 aa, Mycobacterium tuberculosis
NGWDINTPA

SEQ ID NO: 199941 - protein, 9 aa, Mycobacterium tuberculosis
GWDINTPAF

SEQ ID NO: 199942 - protein, 9 aa, Mycobacterium tuberculosis
DINTPAFEW

SEQ ID NO: 199943 - protein, 9 aa, Mycobacterium tuberculosis
NTPAFEWYY

SEQ ID NO: 199944 - protein, 9 aa, Mycobacterium tuberculosis
FEWYYQSGL

SEQ ID NO: 199945 - protein, 9 aa, Mycobacterium tuberculosis
WYYQSGLSI

SEQ ID NO: 199946 - protein, 9 aa, Mycobacterium tuberculosis
YYQSGLSIV

SEQ ID NO: 199947 - protein, 9 aa, Mycobacterium tuberculosis
YQSGLSIVM

SEQ ID NO: 199948 - protein, 9 aa, Mycobacterium tuberculosis
SGLSIVMPV

SEQ ID NO: 199949 - protein, 9 aa, Mycobacterium tuberculosis
MPVGGQSSF

SEQ ID NO: 199950 - protein, 9 aa, Mycobacterium tuberculosis
PVGGQSSFY

SEQ ID NO: 199951 - protein, 9 aa, Mycobacterium tuberculosis
QSSFYSDWY

SEQ ID NO: 199952 - protein, 9 aa, Mycobacterium tuberculosis
FYSDWYSPA

SEQ ID NO: 199953 - protein, 9 aa, Mycobacterium tuberculosis
DWYSPACGK

SEQ ID NO: 199954 - protein, 9 aa, Mycobacterium tuberculosis
KAGCQTYKW

SEQ ID NO: 199955 - protein, 9 aa, Mycobacterium tuberculosis
CQTYKWETF

SEQ ID NO: 199956 - protein, 9 aa, Mycobacterium tuberculosis
QTYKWETFL

SEQ ID NO: 199957 - protein, 9 aa, Mycobacterium tuberculosis
TYKWETFLT

SEQ ID NO: 199958 - protein, 9 aa, Mycobacterium tuberculosis
WETFLTSEL

SEQ ID NO: 199959 - protein, 9 aa, Mycobacterium tuberculosis
FLTSELPQW

SEQ ID NO: 199960 - protein, 9 aa, Mycobacterium tuberculosis
LTSELPQWL

SEQ ID NO: 199961 - protein, 9 aa, Mycobacterium tuberculosis
SELPQWLSA

SEQ ID NO: 199962 - protein, 9 aa, Mycobacterium tuberculosis
LPQWLSANR

SEQ ID NO: 199963 - protein, 9 aa, Mycobacterium tuberculosis
WLSANRAVK

SEQ ID NO: 199964 - protein, 9 aa, Mycobacterium tuberculosis
RAVKPTGSA

SEQ ID NO: 199965 - protein, 9 aa, Mycobacterium tuberculosis
GSAAIGLSM

SEQ ID NO: 199966 - protein, 9 aa, Mycobacterium tuberculosis
SAAIGLSMA

SEQ ID NO: 199967 - protein, 9 aa, Mycobacterium tuberculosis
GLSMAGSSA

SEQ ID NO: 199968 - protein, 9 aa, Mycobacterium tuberculosis
LSMAGSSAM

SEQ ID NO: 199969 - protein, 9 aa, Mycobacterium tuberculosis
SMAGSSAMI

SEQ ID NO: 199970 - protein, 9 aa, Mycobacterium tuberculosis
MAGSSAMIL

SEQ ID NO: 199971 - protein, 9 aa, Mycobacterium tuberculosis
SSAMILAAY

SEQ ID NO: 199972 - protein, 9 aa, Mycobacterium tuberculosis
MILAAYHPQ

SEQ ID NO: 199973 - protein, 9 aa, Mycobacterium tuberculosis
ILAAYHPQQ

SEQ ID NO: 199974 - protein, 9 aa, Mycobacterium tuberculosis
LAAYHPQQF

SEQ ID NO: 199975 - protein, 9 aa, Mycobacterium tuberculosis
AYHPQQFIY

SEQ ID NO: 199976 - protein, 9 aa, Mycobacterium tuberculosis
HPQQFIYAG

SEQ ID NO: 199977 - protein, 9 aa, Mycobacterium tuberculosis
QQFIYAGSL

SEQ ID NO: 199978 - protein, 9 aa, Mycobacterium tuberculosis
FIYAGSLSA

SEQ ID NO: 199979 - protein, 9 aa, Mycobacterium tuberculosis
IYAGSLSAL

SEQ ID NO: 199980 - protein, 9 aa, Mycobacterium tuberculosis
YAGSLSALL

SEQ ID NO: 199981 - protein, 9 aa, Mycobacterium tuberculosis
SLSALLDPS

SEQ ID NO: 199982 - protein, 9 aa, Mycobacterium tuberculosis
ALLDPSQGM

SEQ ID NO: 199983 - protein, 9 aa, Mycobacterium tuberculosis
DPSQGMGPS

SEQ ID NO: 199984 - protein, 9 aa, Mycobacterium tuberculosis
SQGMGPSLI

SEQ ID NO: 199985 - protein, 9 aa, Mycobacterium tuberculosis
GMGPSLIGL

SEQ ID NO: 199986 - protein, 9 aa, Mycobacterium tuberculosis
GPSLIGLAM

SEQ ID NO: 199987 - protein, 9 aa, Mycobacterium tuberculosis
LAMGDAGGY

SEQ ID NO: 199988 - protein, 9 aa, Mycobacterium tuberculosis
AMGDAGGYK

SEQ ID NO: 199989 - protein, 9 aa, Mycobacterium tuberculosis
GGYKAADMW

SEQ ID NO: 199990 - protein, 9 aa, Mycobacterium tuberculosis
DPTQQIPKL

SEQ ID NO: 199991 - protein, 9 aa, Mycobacterium tuberculosis
IPKLVANNT

SEQ ID NO: 199992 - protein, 9 aa, Mycobacterium tuberculosis
KLVANNTRL

SEQ ID NO: 199993 - protein, 9 aa, Mycobacterium tuberculosis
VANNTRLWV

SEQ ID NO: 199994 - protein, 9 aa, Mycobacterium tuberculosis
TPNELGGAN

SEQ ID NO: 199995 - protein, 9 aa, Mycobacterium tuberculosis
ELGGANIPA

SEQ ID NO: 199996 - protein, 9 aa, Mycobacterium tuberculosis
IPAEFLENF

SEQ ID NO: 199997 - protein, 9 aa, Mycobacterium tuberculosis
AEFLENFVR

SEQ ID NO: 199998 - protein, 9 aa, Mycobacterium tuberculosis
NFVRSSNLK

SEQ ID NO: 199999 - protein, 9 aa, Mycobacterium tuberculosis
FVRSSNLKF

SEQ ID NO: 200000 - protein, 9 aa, Mycobacterium tuberculosis
FQDAYNAAG

SEQ ID NO: 200001 - protein, 9 aa, Mycobacterium tuberculosis
NAAGGHNAV

SEQ ID NO: 200002 - protein, 9 aa, Mycobacterium tuberculosis
AAGGHNAVF

SEQ ID NO: 200003 - protein, 9 aa, Mycobacterium tuberculosis
FPPNGTHSW

SEQ ID NO: 200004 - protein, 9 aa, Mycobacterium tuberculosis
YWGAQLNAM

SEQ ID NO: 200005 - protein, 9 aa, Mycobacterium tuberculosis
AMKGDLQSS

SEQ ID NO: 200006 - protein, 9 aa, Mycobacterium tuberculosis
MKGDLQSSL

SEQ ID NO: 200007 - protein, 10 aa, Mycobacterium tuberculosis
VSRKIRAWGR

SEQ ID NO: 200008 - protein, 10 aa, Mycobacterium tuberculosis
KIRAWGRRLM

SEQ ID NO: 200009 - protein, 10 aa, Mycobacterium tuberculosis
RRLMIGTAAA

SEQ ID NO: 200010 - protein, 10 aa, Mycobacterium tuberculosis
RLMIGTAAAV

SEQ ID NO: 200011 - protein, 10 aa, Mycobacterium tuberculosis
LMIGTAAAVV

SEQ ID NO: 200012 - protein, 10 aa, Mycobacterium tuberculosis
MIGTAAAVVL

SEQ ID NO: 200013 - protein, 10 aa, Mycobacterium tuberculosis
TAAAVVLPGL

SEQ ID NO: 200014 - protein, 10 aa, Mycobacterium tuberculosis
AAAVVLPGLV

SEQ ID NO: 200015 - protein, 10 aa, Mycobacterium tuberculosis
AVVLPGLVGL

SEQ ID NO: 200016 - protein, 10 aa, Mycobacterium tuberculosis
VVLPGLVGLA

SEQ ID NO: 200017 - protein, 10 aa, Mycobacterium tuberculosis
LPGLVGLAGG

SEQ ID NO: 200018 - protein, 10 aa, Mycobacterium tuberculosis
GLVGLAGGAA

SEQ ID NO: 200019 - protein, 10 aa, Mycobacterium tuberculosis
GAATAGAFSR

SEQ ID NO: 200020 - protein, 10 aa, Mycobacterium tuberculosis
GAFSRPGLPV

SEQ ID NO: 200021 - protein, 10 aa, Mycobacterium tuberculosis
FSRPGLPVEY

SEQ ID NO: 200022 - protein, 10 aa, Mycobacterium tuberculosis
LPVEYLQVPS

SEQ ID NO: 200023 - protein, 10 aa, Mycobacterium tuberculosis
EYLQVPSPSM

SEQ ID NO: 200024 - protein, 10 aa, Mycobacterium tuberculosis
VPSPSMGRDI

SEQ ID NO: 200025 - protein, 10 aa, Mycobacterium tuberculosis
SPSMGRDIKV

SEQ ID NO: 200026 - protein, 10 aa, Mycobacterium tuberculosis
SMGRDIKVQF

SEQ ID NO: 200027 - protein, 10 aa, Mycobacterium tuberculosis
FQSGGNNSPA

SEQ ID NO: 200028 - protein, 10 aa, Mycobacterium tuberculosis
SPAVYLLDGL

SEQ ID NO: 200029 - protein, 10 aa, Mycobacterium tuberculosis
YLLDGLRAQD

SEQ ID NO: 200030 - protein, 10 aa, Mycobacterium tuberculosis
AQDDYNGWDI

SEQ ID NO: 200031 - protein, 10 aa, Mycobacterium tuberculosis
NGWDINTPAF

SEQ ID NO: 200032 - protein, 10 aa, Mycobacterium tuberculosis
DINTPAFEWY

SEQ ID NO: 200033 - protein, 10 aa, Mycobacterium tuberculosis
NTPAFEWYYQ

SEQ ID NO: 200034 - protein, 10 aa, Mycobacterium tuberculosis
AFEWYYQSGL

SEQ ID NO: 200035 - protein, 10 aa, Mycobacterium tuberculosis
EWYYQSGLSI

SEQ ID NO: 200036 - protein, 10 aa, Mycobacterium tuberculosis
WYYQSGLSIV

SEQ ID NO: 200037 - protein, 10 aa, Mycobacterium tuberculosis
YYQSGLSIVM

SEQ ID NO: 200038 - protein, 10 aa, Mycobacterium tuberculosis
QSGLSIVMPV

SEQ ID NO: 200039 - protein, 10 aa, Mycobacterium tuberculosis
VMPVGGQSSF

SEQ ID NO: 200040 - protein, 10 aa, Mycobacterium tuberculosis
MPVGGQSSFY

SEQ ID NO: 200041 - protein, 10 aa, Mycobacterium tuberculosis
GQSSFYSDWY

SEQ ID NO: 200042 - protein, 10 aa, Mycobacterium tuberculosis
CQTYKWETFL

SEQ ID NO: 200043 - protein, 10 aa, Mycobacterium tuberculosis
QTYKWETFLT

SEQ ID NO: 200044 - protein, 10 aa, Mycobacterium tuberculosis
ETFLTSELPQ

SEQ ID NO: 200045 - protein, 10 aa, Mycobacterium tuberculosis
TFLTSELPQW

SEQ ID NO: 200046 - protein, 10 aa, Mycobacterium tuberculosis
FLTSELPQWL

SEQ ID NO: 200047 - protein, 10 aa, Mycobacterium tuberculosis
ELPQWLSANR

SEQ ID NO: 200048 - protein, 10 aa, Mycobacterium tuberculosis
LPQWLSANRA

SEQ ID NO: 200049 - protein, 10 aa, Mycobacterium tuberculosis
QWLSANRAVK

SEQ ID NO: 200050 - protein, 10 aa, Mycobacterium tuberculosis
RAVKPTGSAA

SEQ ID NO: 200051 - protein, 10 aa, Mycobacterium tuberculosis
AVKPTGSAAI

SEQ ID NO: 200052 - protein, 10 aa, Mycobacterium tuberculosis
KPTGSAAIGL

SEQ ID NO: 200053 - protein, 10 aa, Mycobacterium tuberculosis
GLSMAGSSAM

SEQ ID NO: 200054 - protein, 10 aa, Mycobacterium tuberculosis
LSMAGSSAMI

SEQ ID NO: 200055 - protein, 10 aa, Mycobacterium tuberculosis
SMAGSSAMIL

SEQ ID NO: 200056 - protein, 10 aa, Mycobacterium tuberculosis
MAGSSAMILA

SEQ ID NO: 200057 - protein, 10 aa, Mycobacterium tuberculosis
GSSAMILAAY

SEQ ID NO: 200058 - protein, 10 aa, Mycobacterium tuberculosis
MILAAYHPQQ

SEQ ID NO: 200059 - protein, 10 aa, Mycobacterium tuberculosis
ILAAYHPQQF

SEQ ID NO: 200060 - protein, 10 aa, Mycobacterium tuberculosis
LAAYHPQQFI

SEQ ID NO: 200061 - protein, 10 aa, Mycobacterium tuberculosis
AAYHPQQFIY

SEQ ID NO: 200062 - protein, 10 aa, Mycobacterium tuberculosis
HPQQFIYAGS

SEQ ID NO: 200063 - protein, 10 aa, Mycobacterium tuberculosis
FIYAGSLSAL

SEQ ID NO: 200064 - protein, 10 aa, Mycobacterium tuberculosis
IYAGSLSALL

SEQ ID NO: 200065 - protein, 10 aa, Mycobacterium tuberculosis
SLSALLDPSQ

SEQ ID NO: 200066 - protein, 10 aa, Mycobacterium tuberculosis
ALLDPSQGMG

SEQ ID NO: 200067 - protein, 10 aa, Mycobacterium tuberculosis
LLDPSQGMGP

SEQ ID NO: 200068 - protein, 10 aa, Mycobacterium tuberculosis
DPSQGMGPSL

SEQ ID NO: 200069 - protein, 10 aa, Mycobacterium tuberculosis
QGMGPSLIGL

SEQ ID NO: 200070 - protein, 10 aa, Mycobacterium tuberculosis
GMGPSLIGLA

SEQ ID NO: 200071 - protein, 10 aa, Mycobacterium tuberculosis
SLIGLAMGDA

SEQ ID NO: 200072 - protein, 10 aa, Mycobacterium tuberculosis
GLAMGDAGGY

SEQ ID NO: 200073 - protein, 10 aa, Mycobacterium tuberculosis
LAMGDAGGYK

SEQ ID NO: 200074 - protein, 10 aa, Mycobacterium tuberculosis
AMGDAGGYKA

SEQ ID NO: 200075 - protein, 10 aa, Mycobacterium tuberculosis
DMWGPSSDPA

SEQ ID NO: 200076 - protein, 10 aa, Mycobacterium tuberculosis
DPAWERNDPT

SEQ ID NO: 200077 - protein, 10 aa, Mycobacterium tuberculosis
WERNDPTQQI

SEQ ID NO: 200078 - protein, 10 aa, Mycobacterium tuberculosis
RNDPTQQIPK

SEQ ID NO: 200079 - protein, 10 aa, Mycobacterium tuberculosis
IPKLVANNTR

SEQ ID NO: 200080 - protein, 10 aa, Mycobacterium tuberculosis
KLVANNTRLW

SEQ ID NO: 200081 - protein, 10 aa, Mycobacterium tuberculosis
LVANNTRLWV

SEQ ID NO: 200082 - protein, 10 aa, Mycobacterium tuberculosis
VANNTRLWVY

SEQ ID NO: 200083 - protein, 10 aa, Mycobacterium tuberculosis
YCGNGTPNEL

SEQ ID NO: 200084 - protein, 10 aa, Mycobacterium tuberculosis
TPNELGGANI

SEQ ID NO: 200085 - protein, 10 aa, Mycobacterium tuberculosis
NIPAEFLENF

SEQ ID NO: 200086 - protein, 10 aa, Mycobacterium tuberculosis
IPAEFLENFV

SEQ ID NO: 200087 - protein, 10 aa, Mycobacterium tuberculosis
AEFLENFVRS

SEQ ID NO: 200088 - protein, 10 aa, Mycobacterium tuberculosis
LENFVRSSNL

SEQ ID NO: 200089 - protein, 10 aa, Mycobacterium tuberculosis
ENFVRSSNLK

SEQ ID NO: 200090 - protein, 10 aa, Mycobacterium tuberculosis
NFVRSSNLKF

SEQ ID NO: 200091 - protein, 10 aa, Mycobacterium tuberculosis
SSNLKFQDAY

SEQ ID NO: 200092 - protein, 10 aa, Mycobacterium tuberculosis
NLKFQDAYNA

SEQ ID NO: 200093 - protein, 10 aa, Mycobacterium tuberculosis
FQDAYNAAGG

SEQ ID NO: 200094 - protein, 10 aa, Mycobacterium tuberculosis
YNAAGGHNAV

SEQ ID NO: 200095 - protein, 10 aa, Mycobacterium tuberculosis
NAAGGHNAVF

SEQ ID NO: 200096 - protein, 10 aa, Mycobacterium tuberculosis
NFPPNGTHSW

SEQ ID NO: 200097 - protein, 10 aa, Mycobacterium tuberculosis
PPNGTHSWEY

SEQ ID NO: 200098 - protein, 10 aa, Mycobacterium tuberculosis
HSWEYWGAQL

SEQ ID NO: 200099 - protein, 10 aa, Mycobacterium tuberculosis
WEYWGAQLNA

SEQ ID NO: 200100 - protein, 10 aa, Mycobacterium tuberculosis
EYWGAQLNAM

SEQ ID NO: 200101 - protein, 10 aa, Mycobacterium tuberculosis
AMKGDLQSSL

SEQ ID NO: 200102 - protein, 11 aa, Mycobacterium tuberculosis
MTDVSRKIRAW

SEQ ID NO: 200103 - protein, 11 aa, Mycobacterium tuberculosis
DVSRKIRAWGR

SEQ ID NO: 200104 - protein, 11 aa, Mycobacterium tuberculosis
VSRKIRAWGRR

SEQ ID NO: 200105 - protein, 11 aa, Mycobacterium tuberculosis
KIRAWGRRLMI

SEQ ID NO: 200106 - protein, 11 aa, Mycobacterium tuberculosis
RRLMIGTAAAV

SEQ ID NO: 200107 - protein, 11 aa, Mycobacterium tuberculosis
RLMIGTAAAVV

SEQ ID NO: 200108 - protein, 11 aa, Mycobacterium tuberculosis
LMIGTAAAVVL

SEQ ID NO: 200109 - protein, 11 aa, Mycobacterium tuberculosis
GTAAAVVLPGL

SEQ ID NO: 200110 - protein, 11 aa, Mycobacterium tuberculosis
TAAAVVLPGLV

SEQ ID NO: 200111 - protein, 11 aa, Mycobacterium tuberculosis
AAVVLPGLVGL

SEQ ID NO: 200112 - protein, 11 aa, Mycobacterium tuberculosis
LPGLVGLAGGA

SEQ ID NO: 200113 - protein, 11 aa, Mycobacterium tuberculosis
GLVGLAGGAAT

SEQ ID NO: 200114 - protein, 11 aa, Mycobacterium tuberculosis
GLAGGAATAGA

SEQ ID NO: 200115 - protein, 11 aa, Mycobacterium tuberculosis
LAGGAATAGAF

SEQ ID NO: 200116 - protein, 11 aa, Mycobacterium tuberculosis
ATAGAFSRPGL

SEQ ID NO: 200117 - protein, 11 aa, Mycobacterium tuberculosis
AFSRPGLPVEY

SEQ ID NO: 200118 - protein, 11 aa, Mycobacterium tuberculosis
FSRPGLPVEYL

SEQ ID NO: 200119 - protein, 11 aa, Mycobacterium tuberculosis
RPGLPVEYLQV

SEQ ID NO: 200120 - protein, 11 aa, Mycobacterium tuberculosis
LPVEYLQVPSP

SEQ ID NO: 200121 - protein, 11 aa, Mycobacterium tuberculosis
VEYLQVPSPSM

SEQ ID NO: 200122 - protein, 11 aa, Mycobacterium tuberculosis
YLQVPSPSMGR

SEQ ID NO: 200123 - protein, 11 aa, Mycobacterium tuberculosis
SMGRDIKVQFQ

SEQ ID NO: 200124 - protein, 11 aa, Mycobacterium tuberculosis
FQSGGNNSPAV

SEQ ID NO: 200125 - protein, 11 aa, Mycobacterium tuberculosis
QSGGNNSPAVY

SEQ ID NO: 200126 - protein, 11 aa, Mycobacterium tuberculosis
NSPAVYLLDGL

SEQ ID NO: 200127 - protein, 11 aa, Mycobacterium tuberculosis
SPAVYLLDGLR

SEQ ID NO: 200128 - protein, 11 aa, Mycobacterium tuberculosis
YLLDGLRAQDD

SEQ ID NO: 200129 - protein, 11 aa, Mycobacterium tuberculosis
LLDGLRAQDDY

SEQ ID NO: 200130 - protein, 11 aa, Mycobacterium tuberculosis
YNGWDINTPAF

SEQ ID NO: 200131 - protein, 11 aa, Mycobacterium tuberculosis
GWDINTPAFEW

SEQ ID NO: 200132 - protein, 11 aa, Mycobacterium tuberculosis
DINTPAFEWYY

SEQ ID NO: 200133 - protein, 11 aa, Mycobacterium tuberculosis
PAFEWYYQSGL

SEQ ID NO: 200134 - protein, 11 aa, Mycobacterium tuberculosis
FEWYYQSGLSI

SEQ ID NO: 200135 - protein, 11 aa, Mycobacterium tuberculosis
WYYQSGLSIVM

SEQ ID NO: 200136 - protein, 11 aa, Mycobacterium tuberculosis
YYQSGLSIVMP

SEQ ID NO: 200137 - protein, 11 aa, Mycobacterium tuberculosis
YQSGLSIVMPV

SEQ ID NO: 200138 - protein, 11 aa, Mycobacterium tuberculosis
IVMPVGGQSSF

SEQ ID NO: 200139 - protein, 11 aa, Mycobacterium tuberculosis
VMPVGGQSSFY

SEQ ID NO: 200140 - protein, 11 aa, Mycobacterium tuberculosis
MPVGGQSSFYS

SEQ ID NO: 200141 - protein, 11 aa, Mycobacterium tuberculosis
VGGQSSFYSDW

SEQ ID NO: 200142 - protein, 11 aa, Mycobacterium tuberculosis
SSFYSDWYSPA

SEQ ID NO: 200143 - protein, 11 aa, Mycobacterium tuberculosis
YSDWYSPACGK

SEQ ID NO: 200144 - protein, 11 aa, Mycobacterium tuberculosis
SPACGKAGCQT

SEQ ID NO: 200145 - protein, 11 aa, Mycobacterium tuberculosis
ACGKAGCQTYK

SEQ ID NO: 200146 - protein, 11 aa, Mycobacterium tuberculosis
CQTYKWETFLT

SEQ ID NO: 200147 - protein, 11 aa, Mycobacterium tuberculosis
YKWETFLTSEL

SEQ ID NO: 200148 - protein, 11 aa, Mycobacterium tuberculosis
ETFLTSELPQW

SEQ ID NO: 200149 - protein, 11 aa, Mycobacterium tuberculosis
TFLTSELPQWL

SEQ ID NO: 200150 - protein, 11 aa, Mycobacterium tuberculosis
FLTSELPQWLS

SEQ ID NO: 200151 - protein, 11 aa, Mycobacterium tuberculosis
LTSELPQWLSA

SEQ ID NO: 200152 - protein, 11 aa, Mycobacterium tuberculosis
ELPQWLSANRA

SEQ ID NO: 200153 - protein, 11 aa, Mycobacterium tuberculosis
LPQWLSANRAV

SEQ ID NO: 200154 - protein, 11 aa, Mycobacterium tuberculosis
RAVKPTGSAAI

SEQ ID NO: 200155 - protein, 11 aa, Mycobacterium tuberculosis
AIGLSMAGSSA

SEQ ID NO: 200156 - protein, 11 aa, Mycobacterium tuberculosis
GLSMAGSSAMI

SEQ ID NO: 200157 - protein, 11 aa, Mycobacterium tuberculosis
SMAGSSAMILA

SEQ ID NO: 200158 - protein, 11 aa, Mycobacterium tuberculosis
MILAAYHPQQF

SEQ ID NO: 200159 - protein, 11 aa, Mycobacterium tuberculosis
ILAAYHPQQFI

SEQ ID NO: 200160 - protein, 11 aa, Mycobacterium tuberculosis
LAAYHPQQFIY

SEQ ID NO: 200161 - protein, 11 aa, Mycobacterium tuberculosis
AAYHPQQFIYA

SEQ ID NO: 200162 - protein, 11 aa, Mycobacterium tuberculosis
HPQQFIYAGSL

SEQ ID NO: 200163 - protein, 11 aa, Mycobacterium tuberculosis
QQFIYAGSLSA

SEQ ID NO: 200164 - protein, 11 aa, Mycobacterium tuberculosis
QFIYAGSLSAL

SEQ ID NO: 200165 - protein, 11 aa, Mycobacterium tuberculosis
FIYAGSLSALL

SEQ ID NO: 200166 - protein, 11 aa, Mycobacterium tuberculosis
ALLDPSQGMGP

SEQ ID NO: 200167 - protein, 11 aa, Mycobacterium tuberculosis
LLDPSQGMGPS

SEQ ID NO: 200168 - protein, 11 aa, Mycobacterium tuberculosis
SQGMGPSLIGL

SEQ ID NO: 200169 - protein, 11 aa, Mycobacterium tuberculosis
QGMGPSLIGLA

SEQ ID NO: 200170 - protein, 11 aa, Mycobacterium tuberculosis
GMGPSLIGLAM

SEQ ID NO: 200171 - protein, 11 aa, Mycobacterium tuberculosis
GLAMGDAGGYK

SEQ ID NO: 200172 - protein, 11 aa, Mycobacterium tuberculosis
AMGDAGGYKAA

SEQ ID NO: 200173 - protein, 11 aa, Mycobacterium tuberculosis
QQIPKLVANNT

SEQ ID NO: 200174 - protein, 11 aa, Mycobacterium tuberculosis
QIPKLVANNTR

SEQ ID NO: 200175 - protein, 11 aa, Mycobacterium tuberculosis
IPKLVANNTRL

SEQ ID NO: 200176 - protein, 11 aa, Mycobacterium tuberculosis
KLVANNTRLWV

SEQ ID NO: 200177 - protein, 11 aa, Mycobacterium tuberculosis
LVANNTRLWVY

SEQ ID NO: 200178 - protein, 11 aa, Mycobacterium tuberculosis
VYCGNGTPNEL

SEQ ID NO: 200179 - protein, 11 aa, Mycobacterium tuberculosis
NIPAEFLENFV

SEQ ID NO: 200180 - protein, 11 aa, Mycobacterium tuberculosis
IPAEFLENFVR

SEQ ID NO: 200181 - protein, 11 aa, Mycobacterium tuberculosis
AEFLENFVRSS

SEQ ID NO: 200182 - protein, 11 aa, Mycobacterium tuberculosis
FLENFVRSSNL

SEQ ID NO: 200183 - protein, 11 aa, Mycobacterium tuberculosis
RSSNLKFQDAY

SEQ ID NO: 200184 - protein, 11 aa, Mycobacterium tuberculosis
NLKFQDAYNAA

SEQ ID NO: 200185 - protein, 11 aa, Mycobacterium tuberculosis
DAYNAAGGHNA

SEQ ID NO: 200186 - protein, 11 aa, Mycobacterium tuberculosis
YNAAGGHNAVF

SEQ ID NO: 200187 - protein, 11 aa, Mycobacterium tuberculosis
AVFNFPPNGTH

SEQ ID NO: 200188 - protein, 11 aa, Mycobacterium tuberculosis
FPPNGTHSWEY

SEQ ID NO: 200189 - protein, 11 aa, Mycobacterium tuberculosis
PPNGTHSWEYW

SEQ ID NO: 200190 - protein, 11 aa, Mycobacterium tuberculosis
THSWEYWGAQL

SEQ ID NO: 200191 - protein, 11 aa, Mycobacterium tuberculosis
WEYWGAQLNAM

SEQ ID NO: 200192 - protein, 11 aa, Mycobacterium tuberculosis
EYWGAQLNAMK

SEQ ID NO: 200193 - protein, 11 aa, Mycobacterium tuberculosis
NAMKGDLQSSL

SEQ ID NO: 200194 - protein, 338 aa, Mycobacterium tuberculosis; identical to SEQ ID NO: 81

SEQ ID NO: 200195 - protein, 8 aa, Mycobacterium tuberculosis
MQLVDRVR

SEQ ID NO: 200196 - protein, 8 aa, Mycobacterium tuberculosis
GAVTGMSR

SEQ ID NO: 200197 - protein, 8 aa, Mycobacterium tuberculosis
AVTGMSRR

SEQ ID NO: 200198 - protein, 8 aa, Mycobacterium tuberculosis
TGMSRRLV

SEQ ID NO: 200199 - protein, 8 aa, Mycobacterium tuberculosis
GMSRRLVV

SEQ ID NO: 200200 - protein, 8 aa, Mycobacterium tuberculosis
RRLVVGAV

SEQ ID NO: 200201 - protein, 8 aa, Mycobacterium tuberculosis
LVVGAVGA

SEQ ID NO: 200202 - protein, 8 aa, Mycobacterium tuberculosis
GAVGAALV

SEQ ID NO: 200203 - protein, 8 aa, Mycobacterium tuberculosis
GAALVSGL

SEQ ID NO: 200204 - protein, 8 aa, Mycobacterium tuberculosis
AALVSGLV

SEQ ID NO: 200205 - protein, 8 aa, Mycobacterium tuberculosis
LVSGLVGA

SEQ ID NO: 200206 - protein, 8 aa, Mycobacterium tuberculosis
AVGGTATA

SEQ ID NO: 200207 - protein, 8 aa, Mycobacterium tuberculosis
GTATAGAF

SEQ ID NO: 200208 - protein, 8 aa, Mycobacterium tuberculosis
ATAGAFSR

SEQ ID NO: 200209 - protein, 8 aa, Mycobacterium tuberculosis
FSRPGLPV

SEQ ID NO: 200210 - protein, 8 aa, Mycobacterium tuberculosis
RPGLPVEY

SEQ ID NO: 200211 - protein, 8 aa, Mycobacterium tuberculosis
GLPVEYLQ

SEQ ID NO: 200212 - protein, 8 aa, Mycobacterium tuberculosis
LPVEYLQV

SEQ ID NO: 200213 - protein, 8 aa, Mycobacterium tuberculosis
LQVPSPSM

SEQ ID NO: 200214 - protein, 8 aa, Mycobacterium tuberculosis
SPSMGRDI

SEQ ID NO: 200215 - protein, 8 aa, Mycobacterium tuberculosis
PSMGRDIK

SEQ ID NO: 200216 - protein, 8 aa, Mycobacterium tuberculosis
SMGRDIKV

SEQ ID NO: 200217 - protein, 8 aa, Mycobacterium tuberculosis
VQFQSGGA

SEQ ID NO: 200218 - protein, 8 aa, Mycobacterium tuberculosis
FQSGGANS

SEQ ID NO: 200219 - protein, 8 aa, Mycobacterium tuberculosis
NSPALYLL

SEQ ID NO: 200220 - protein, 8 aa, Mycobacterium tuberculosis
ALYLLDGL

SEQ ID NO: 200221 - protein, 8 aa, Mycobacterium tuberculosis
LYLLDGLR

SEQ ID NO: 200222 - protein, 8 aa, Mycobacterium tuberculosis
YLLDGLRA

SEQ ID NO: 200223 - protein, 8 aa, Mycobacterium tuberculosis
LLDGLRAQ

SEQ ID NO: 200224 - protein, 8 aa, Mycobacterium tuberculosis
WDINTPAF

SEQ ID NO: 200225 - protein, 8 aa, Mycobacterium tuberculosis
INTPAFEW

SEQ ID NO: 200226 - protein, 8 aa, Mycobacterium tuberculosis
NTPAFEWY

SEQ ID NO: 200227 - protein, 8 aa, Mycobacterium tuberculosis
GLSVVMPV

SEQ ID NO: 200228 - protein, 8 aa, Mycobacterium tuberculosis
MPVGGQSS

SEQ ID NO: 200229 - protein, 8 aa, Mycobacterium tuberculosis
QSSFYSDW

SEQ ID NO: 200230 - protein, 8 aa, Mycobacterium tuberculosis
SSFYSDWY

SEQ ID NO: 200231 - protein, 8 aa, Mycobacterium tuberculosis
YSDWYQPA

SEQ ID NO: 200232 - protein, 8 aa, Mycobacterium tuberculosis
WYQPACGK

SEQ ID NO: 200233 - protein, 8 aa, Mycobacterium tuberculosis
YQPACGKA

SEQ ID NO: 200234 - protein, 8 aa, Mycobacterium tuberculosis
KAGCQTYK

SEQ ID NO: 200235 - protein, 8 aa, Mycobacterium tuberculosis
QTYKWETF

SEQ ID NO: 200236 - protein, 8 aa, Mycobacterium tuberculosis
TYKWETFL

SEQ ID NO: 200237 - protein, 8 aa, Mycobacterium tuberculosis
ETFLTSEL

SEQ ID NO: 200238 - protein, 8 aa, Mycobacterium tuberculosis
LTSELPGW

SEQ ID NO: 200239 - protein, 8 aa, Mycobacterium tuberculosis
ELPGWLQA

SEQ ID NO: 200240 - protein, 8 aa, Mycobacterium tuberculosis
LPGWLQAN

SEQ ID NO: 200241 - protein, 8 aa, Mycobacterium tuberculosis
WLQANRHV

SEQ ID NO: 200242 - protein, 8 aa, Mycobacterium tuberculosis
LQANRHVK

SEQ ID NO: 200243 - protein, 8 aa, Mycobacterium tuberculosis
HVKPTGSA

SEQ ID NO: 200244 - protein, 8 aa, Mycobacterium tuberculosis
KPTGSAVV

SEQ ID NO: 200245 - protein, 8 aa, Mycobacterium tuberculosis
TGSAVVGL

SEQ ID NO: 200246 - protein, 8 aa, Mycobacterium tuberculosis
SAVVGLSM

SEQ ID NO: 200247 - protein, 8 aa, Mycobacterium tuberculosis
AVVGLSMA

SEQ ID NO: 200248 - protein, 8 aa, Mycobacterium tuberculosis
LSMAASSA

SEQ ID NO: 200249 - protein, 8 aa, Mycobacterium tuberculosis
SMAASSAL

SEQ ID NO: 200250 - protein, 8 aa, Mycobacterium tuberculosis
MAASSALT

SEQ ID NO: 200251 - protein, 8 aa, Mycobacterium tuberculosis
AASSALTL

SEQ ID NO: 200252 - protein, 8 aa, Mycobacterium tuberculosis
SSALTLAI

SEQ ID NO: 200253 - protein, 8 aa, Mycobacterium tuberculosis
SALTLAIY

SEQ ID NO: 200254 - protein, 8 aa, Mycobacterium tuberculosis
TLAIYHPQ

SEQ ID NO: 200255 - protein, 8 aa, Mycobacterium tuberculosis
IYHPQQFV

SEQ ID NO: 200256 - protein, 8 aa, Mycobacterium tuberculosis
YHPQQFVY

SEQ ID NO: 200257 - protein, 8 aa, Mycobacterium tuberculosis
HPQQFVYA

SEQ ID NO: 200258 - protein, 8 aa, Mycobacterium tuberculosis
QQFVYAGA

SEQ ID NO: 200259 - protein, 8 aa, Mycobacterium tuberculosis
QFVYAGAM

SEQ ID NO: 200260 - protein, 8 aa, Mycobacterium tuberculosis
YAGAMSGL

SEQ ID NO: 200261 - protein, 8 aa, Mycobacterium tuberculosis
GLLDPSQA

SEQ ID NO: 200262 - protein, 8 aa, Mycobacterium tuberculosis
LLDPSQAM

SEQ ID NO: 200263 - protein, 8 aa, Mycobacterium tuberculosis
SQAMGPTL

SEQ ID NO: 200264 - protein, 8 aa, Mycobacterium tuberculosis
QAMGPTLI

SEQ ID NO: 200265 - protein, 8 aa, Mycobacterium tuberculosis
MGPTLIGL

SEQ ID NO: 200266 - protein, 8 aa, Mycobacterium tuberculosis
GPTLIGLA

SEQ ID NO: 200267 - protein, 8 aa, Mycobacterium tuberculosis
PTLIGLAM

SEQ ID NO: 200268 - protein, 8 aa, Mycobacterium tuberculosis
AMGDAGGY

SEQ ID NO: 200269 - protein, 8 aa, Mycobacterium tuberculosis
GYKASDMW

SEQ ID NO: 200270 - protein, 8 aa, Mycobacterium tuberculosis
ASDMWGPK

SEQ ID NO: 200271 - protein, 8 aa, Mycobacterium tuberculosis
WQRNDPLL

SEQ ID NO: 200272 - protein, 8 aa, Mycobacterium tuberculosis
RNDPLLNV

SEQ ID NO: 200273 - protein, 8 aa, Mycobacterium tuberculosis
PLLNVGKL

SEQ ID NO: 200274 - protein, 8 aa, Mycobacterium tuberculosis
LLNVGKLI

SEQ ID NO: 200275 - protein, 8 aa, Mycobacterium tuberculosis
KLIANNTR

SEQ ID NO: 200276 - protein, 8 aa, Mycobacterium tuberculosis
LIANNTRV

SEQ ID NO: 200277 - protein, 8 aa, Mycobacterium tuberculosis
IANNTRVW

SEQ ID NO: 200278 - protein, 8 aa, Mycobacterium tuberculosis
WVYCGNGK

SEQ ID NO: 200279 - protein, 8 aa, Mycobacterium tuberculosis
KFLEGFVR

SEQ ID NO: 200280 - protein, 8 aa, Mycobacterium tuberculosis
FLEGFVRT

SEQ ID NO: 200281 - protein, 8 aa, Mycobacterium tuberculosis
GFVRTSNI

SEQ ID NO: 200282 - protein, 8 aa, Mycobacterium tuberculosis
FVRTSNIK

SEQ ID NO: 200283 - protein, 8 aa, Mycobacterium tuberculosis
NIKFQDAY

SEQ ID NO: 200284 - protein, 8 aa, Mycobacterium tuberculosis
FQDAYNAG

SEQ ID NO: 200285 - protein, 8 aa, Mycobacterium tuberculosis
FPDSGTHS

SEQ ID NO: 200286 - protein, 8 aa, Mycobacterium tuberculosis
GTHSWEYW

SEQ ID NO: 200287 - protein, 8 aa, Mycobacterium tuberculosis
HSWEYWGA

SEQ ID NO: 200288 - protein, 8 aa, Mycobacterium tuberculosis
WEYWGAQL

SEQ ID NO: 200289 - protein, 8 aa, Mycobacterium tuberculosis
WGAQLNAM

SEQ ID NO: 200290 - protein, 8 aa, Mycobacterium tuberculosis
GAQLNAMK

SEQ ID NO: 200291 - protein, 8 aa, Mycobacterium tuberculosis
AMKPDLQR

SEQ ID NO: 200292 - protein, 8 aa, Mycobacterium tuberculosis
KPDLQRAL

SEQ ID NO: 200293 - protein, 8 aa, Mycobacterium tuberculosis
LQRALGAT

SEQ ID NO: 200294 - protein, 9 aa, Mycobacterium tuberculosis
QLVDRVRGA

SEQ ID NO: 200295 - protein, 9 aa, Mycobacterium tuberculosis
LVDRVRGAV

SEQ ID NO: 200296 - protein, 9 aa, Mycobacterium tuberculosis
RVRGAVTGM

SEQ ID NO: 200297 - protein, 9 aa, Mycobacterium tuberculosis
GAVTGMSRR

SEQ ID NO: 200298 - protein, 9 aa, Mycobacterium tuberculosis
AVTGMSRRL

SEQ ID NO: 200299 - protein, 9 aa, Mycobacterium tuberculosis
TGMSRRLVV

SEQ ID NO: 200300 - protein, 9 aa, Mycobacterium tuberculosis
RLVVGAVGA

SEQ ID NO: 200301 - protein, 9 aa, Mycobacterium tuberculosis
LVVGAVGAA

SEQ ID NO: 200302 - protein, 9 aa, Mycobacterium tuberculosis
VVGAVGAAL

SEQ ID NO: 200303 - protein, 9 aa, Mycobacterium tuberculosis
VGAALVSGL

SEQ ID NO: 200304 - protein, 9 aa, Mycobacterium tuberculosis
GAALVSGLV

SEQ ID NO: 200305 - protein, 9 aa, Mycobacterium tuberculosis
ALVSGLVGA

SEQ ID NO: 200306 - protein, 9 aa, Mycobacterium tuberculosis
LVSGLVGAV

SEQ ID NO: 200307 - protein, 9 aa, Mycobacterium tuberculosis
GLVGAVGGT

SEQ ID NO: 200308 - protein, 9 aa, Mycobacterium tuberculosis
GAVGGTATA

SEQ ID NO: 200309 - protein, 9 aa, Mycobacterium tuberculosis
TATAGAFSR

SEQ ID NO: 200310 - protein, 9 aa, Mycobacterium tuberculosis
RPGLPVEYL

SEQ ID NO: 200311 - protein, 9 aa, Mycobacterium tuberculosis
GLPVEYLQV

SEQ ID NO: 200312 - protein, 9 aa, Mycobacterium tuberculosis
LPVEYLQVP

SEQ ID NO: 200313 - protein, 9 aa, Mycobacterium tuberculosis
YLQVPSPSM

SEQ ID NO: 200314 - protein, 9 aa, Mycobacterium tuberculosis
QVPSPSMGR

SEQ ID NO: 200315 - protein, 9 aa, Mycobacterium tuberculosis
FQSGGANSP

SEQ ID NO: 200316 - protein, 9 aa, Mycobacterium tuberculosis
ANSPALYLL

SEQ ID NO: 200317 - protein, 9 aa, Mycobacterium tuberculosis
ALYLLDGLR

SEQ ID NO: 200318 - protein, 9 aa, Mycobacterium tuberculosis
YLLDGLRAQ

SEQ ID NO: 200319 - protein, 9 aa, Mycobacterium tuberculosis
LLDGLRAQD

SEQ ID NO: 200320 - protein, 9 aa, Mycobacterium tuberculosis
RAQDDFSGW

SEQ ID NO: 200321 - protein, 9 aa, Mycobacterium tuberculosis
SGWDINTPA

SEQ ID NO: 200322 - protein, 9 aa, Mycobacterium tuberculosis
GWDINTPAF

SEQ ID NO: 200323 - protein, 9 aa, Mycobacterium tuberculosis
DINTPAFEW

SEQ ID NO: 200324 - protein, 9 aa, Mycobacterium tuberculosis
FEWYDQSGL

SEQ ID NO: 200325 - protein, 9 aa, Mycobacterium tuberculosis
WYDQSGLSV

SEQ ID NO: 200326 - protein, 9 aa, Mycobacterium tuberculosis
YDQSGLSVV

SEQ ID NO: 200327 - protein, 9 aa, Mycobacterium tuberculosis
SGLSVVMPV

SEQ ID NO: 200328 - protein, 9 aa, Mycobacterium tuberculosis
MPVGGQSSF

SEQ ID NO: 200329 - protein, 9 aa, Mycobacterium tuberculosis
PVGGQSSFY

SEQ ID NO: 200330 - protein, 9 aa, Mycobacterium tuberculosis
QSSFYSDWY

SEQ ID NO: 200331 - protein, 9 aa, Mycobacterium tuberculosis
SSFYSDWYQ

SEQ ID NO: 200332 - protein, 9 aa, Mycobacterium tuberculosis
FYSDWYQPA

SEQ ID NO: 200333 - protein, 9 aa, Mycobacterium tuberculosis
KAGCQTYKW

SEQ ID NO: 200334 - protein, 9 aa, Mycobacterium tuberculosis
CQTYKWETF

SEQ ID NO: 200335 - protein, 9 aa, Mycobacterium tuberculosis
QTYKWETFL

SEQ ID NO: 200336 - protein, 9 aa, Mycobacterium tuberculosis
TYKWETFLT

SEQ ID NO: 200337 - protein, 9 aa, Mycobacterium tuberculosis
WETFLTSEL

SEQ ID NO: 200338 - protein, 9 aa, Mycobacterium tuberculosis
FLTSELPGW

SEQ ID NO: 200339 - protein, 9 aa, Mycobacterium tuberculosis
LTSELPGWL

SEQ ID NO: 200340 - protein, 9 aa, Mycobacterium tuberculosis
SELPGWLQA

SEQ ID NO: 200341 - protein, 9 aa, Mycobacterium tuberculosis
ELPGWLQAN

SEQ ID NO: 200342 - protein, 9 aa, Mycobacterium tuberculosis
WLQANRHVK

SEQ ID NO: 200343 - protein, 9 aa, Mycobacterium tuberculosis
HVKPTGSAV

SEQ ID NO: 200344 - protein, 9 aa, Mycobacterium tuberculosis
GSAVVGLSM

SEQ ID NO: 200345 - protein, 9 aa, Mycobacterium tuberculosis
SAVVGLSMA

SEQ ID NO: 200346 - protein, 9 aa, Mycobacterium tuberculosis
AVVGLSMAA

SEQ ID NO: 200347 - protein, 9 aa, Mycobacterium tuberculosis
GLSMAASSA

SEQ ID NO: 200348 - protein, 9 aa, Mycobacterium tuberculosis
LSMAASSAL

SEQ ID NO: 200349 - protein, 9 aa, Mycobacterium tuberculosis
SMAASSALT

SEQ ID NO: 200350 - protein, 9 aa, Mycobacterium tuberculosis
MAASSALTL

SEQ ID NO: 200351 - protein, 9 aa, Mycobacterium tuberculosis
AASSALTLA

SEQ ID NO: 200352 - protein, 9 aa, Mycobacterium tuberculosis
SSALTLAIY

SEQ ID NO: 200353 - protein, 9 aa, Mycobacterium tuberculosis
TLAIYHPQQ

SEQ ID NO: 200354 - protein, 9 aa, Mycobacterium tuberculosis
LAIYHPQQF

SEQ ID NO: 200355 - protein, 9 aa, Mycobacterium tuberculosis
AIYHPQQFV

SEQ ID NO: 200356 - protein, 9 aa, Mycobacterium tuberculosis
IYHPQQFVY

SEQ ID NO: 200357 - protein, 9 aa, Mycobacterium tuberculosis
HPQQFVYAG

SEQ ID NO: 200358 - protein, 9 aa, Mycobacterium tuberculosis
QQFVYAGAM

SEQ ID NO: 200359 - protein, 9 aa, Mycobacterium tuberculosis
VYAGAMSGL

SEQ ID NO: 200360 - protein, 9 aa, Mycobacterium tuberculosis
YAGAMSGLL

SEQ ID NO: 200361 - protein, 9 aa, Mycobacterium tuberculosis
AMSGLLDPS

SEQ ID NO: 200362 - protein, 9 aa, Mycobacterium tuberculosis
GLLDPSQAM

SEQ ID NO: 200363 - protein, 9 aa, Mycobacterium tuberculosis
LLDPSQAMG

SEQ ID NO: 200364 - protein, 9 aa, Mycobacterium tuberculosis
DPSQAMGPT

SEQ ID NO: 200365 - protein, 9 aa, Mycobacterium tuberculosis
SQAMGPTLI

SEQ ID NO: 200366 - protein, 9 aa, Mycobacterium tuberculosis
AMGPTLIGL

SEQ ID NO: 200367 - protein, 9 aa, Mycobacterium tuberculosis
GPTLIGLAM

SEQ ID NO: 200368 - protein, 9 aa, Mycobacterium tuberculosis
LAMGDAGGY

SEQ ID NO: 200369 - protein, 9 aa, Mycobacterium tuberculosis
AMGDAGGYK

SEQ ID NO: 200370 - protein, 9 aa, Mycobacterium tuberculosis
GGYKASDMW

SEQ ID NO: 200371 - protein, 9 aa, Mycobacterium tuberculosis
KASDMWGPK

SEQ ID NO: 200372 - protein, 9 aa, Mycobacterium tuberculosis
AWQRNDPLL

SEQ ID NO: 200373 - protein, 9 aa, Mycobacterium tuberculosis
PLLNVGKLI

SEQ ID NO: 200374 - protein, 9 aa, Mycobacterium tuberculosis
LLNVGKLIA

SEQ ID NO: 200375 - protein, 9 aa, Mycobacterium tuberculosis
KLIANNTRV

SEQ ID NO: 200376 - protein, 9 aa, Mycobacterium tuberculosis
LIANNTRVW

SEQ ID NO: 200377 - protein, 9 aa, Mycobacterium tuberculosis
IANNTRVWV

SEQ ID NO: 200378 - protein, 9 aa, Mycobacterium tuberculosis
VWVYCGNGK

SEQ ID NO: 200379 - protein, 9 aa, Mycobacterium tuberculosis
DLGGNNLPA

SEQ ID NO: 200380 - protein, 9 aa, Mycobacterium tuberculosis
LPAKFLEGF

SEQ ID NO: 200381 - protein, 9 aa, Mycobacterium tuberculosis
FLEGFVRTS

SEQ ID NO: 200382 - protein, 9 aa, Mycobacterium tuberculosis
EGFVRTSNI

SEQ ID NO: 200383 - protein, 9 aa, Mycobacterium tuberculosis
GFVRTSNIK

SEQ ID NO: 200384 - protein, 9 aa, Mycobacterium tuberculosis
FVRTSNIKF

SEQ ID NO: 200385 - protein, 9 aa, Mycobacterium tuberculosis
FQDAYNAGG

SEQ ID NO: 200386 - protein, 9 aa, Mycobacterium tuberculosis
NAGGGHNGV

SEQ ID NO: 200387 - protein, 9 aa, Mycobacterium tuberculosis
FPDSGTHSW

SEQ ID NO: 200388 - protein, 9 aa, Mycobacterium tuberculosis
DSGTHSWEY

SEQ ID NO: 200389 - protein, 9 aa, Mycobacterium tuberculosis
SGTHSWEYW

SEQ ID NO: 200390 - protein, 9 aa, Mycobacterium tuberculosis
YWGAQLNAM

SEQ ID NO: 200391 - protein, 9 aa, Mycobacterium tuberculosis
QLNAMKPDL

SEQ ID NO: 200392 - protein, 9 aa, Mycobacterium tuberculosis
NAMKPDLQR

SEQ ID NO: 200393 - protein, 9 aa, Mycobacterium tuberculosis
AMKPDLQRA

SEQ ID NO: 200394 - protein, 9 aa, Mycobacterium tuberculosis
TPNTGPAPQ

SEQ ID NO: 200395 - protein, 9 aa, Mycobacterium tuberculosis
NTGPAPQGA

SEQ ID NO: 200396 - protein, 10 aa, Mycobacterium tuberculosis
MQLVDRVRGA

SEQ ID NO: 200397 - protein, 10 aa, Mycobacterium tuberculosis
QLVDRVRGAV

SEQ ID NO: 200398 - protein, 10 aa, Mycobacterium tuberculosis
RVRGAVTGMS

SEQ ID NO: 200399 - protein, 10 aa, Mycobacterium tuberculosis
AVTGMSRRLV

SEQ ID NO: 200400 - protein, 10 aa, Mycobacterium tuberculosis
GMSRRLVVGA

SEQ ID NO: 200401 - protein, 10 aa, Mycobacterium tuberculosis
MSRRLVVGAV

SEQ ID NO: 200402 - protein, 10 aa, Mycobacterium tuberculosis
RRLVVGAVGA

SEQ ID NO: 200403 - protein, 10 aa, Mycobacterium tuberculosis
RLVVGAVGAA

SEQ ID NO: 200404 - protein, 10 aa, Mycobacterium tuberculosis
LVVGAVGAAL

SEQ ID NO: 200405 - protein, 10 aa, Mycobacterium tuberculosis
VVGAVGAALV

SEQ ID NO: 200406 - protein, 10 aa, Mycobacterium tuberculosis
AVGAALVSGL

SEQ ID NO: 200407 - protein, 10 aa, Mycobacterium tuberculosis
VGAALVSGLV

SEQ ID NO: 200408 - protein, 10 aa, Mycobacterium tuberculosis
ALVSGLVGAV

SEQ ID NO: 200409 - protein, 10 aa, Mycobacterium tuberculosis
GLVGAVGGTA

SEQ ID NO: 200410 - protein, 10 aa, Mycobacterium tuberculosis
AVGGTATAGA

SEQ ID NO: 200411 - protein, 10 aa, Mycobacterium tuberculosis
GTATAGAFSR

SEQ ID NO: 200412 - protein, 10 aa, Mycobacterium tuberculosis
GAFSRPGLPV

SEQ ID NO: 200413 - protein, 10 aa, Mycobacterium tuberculosis
FSRPGLPVEY

SEQ ID NO: 200414 - protein, 10 aa, Mycobacterium tuberculosis
LPVEYLQVPS

SEQ ID NO: 200415 - protein, 10 aa, Mycobacterium tuberculosis
EYLQVPSPSM

SEQ ID NO: 200416 - protein, 10 aa, Mycobacterium tuberculosis
VPSPSMGRDI

SEQ ID NO: 200417 - protein, 10 aa, Mycobacterium tuberculosis
SPSMGRDIKV

SEQ ID NO: 200418 - protein, 10 aa, Mycobacterium tuberculosis
SMGRDIKVQF

SEQ ID NO: 200419 - protein, 10 aa, Mycobacterium tuberculosis
FQSGGANSPA

SEQ ID NO: 200420 - protein, 10 aa, Mycobacterium tuberculosis
GANSPALYLL

SEQ ID NO: 200421 - protein, 10 aa, Mycobacterium tuberculosis
SPALYLLDGL

SEQ ID NO: 200422 - protein, 10 aa, Mycobacterium tuberculosis
ALYLLDGLRA

SEQ ID NO: 200423 - protein, 10 aa, Mycobacterium tuberculosis
YLLDGLRAQD

SEQ ID NO: 200424 - protein, 10 aa, Mycobacterium tuberculosis
AQDDFSGWDI

SEQ ID NO: 200425 - protein, 10 aa, Mycobacterium tuberculosis
FSGWDINTPA

SEQ ID NO: 200426 - protein, 10 aa, Mycobacterium tuberculosis
SGWDINTPAF

SEQ ID NO: 200427 - protein, 10 aa, Mycobacterium tuberculosis
DINTPAFEWY

SEQ ID NO: 200428 - protein, 10 aa, Mycobacterium tuberculosis
EWYDQSGLSV

SEQ ID NO: 200429 - protein, 10 aa, Mycobacterium tuberculosis
WYDQSGLSVV

SEQ ID NO: 200430 - protein, 10 aa, Mycobacterium tuberculosis
QSGLSVVMPV

SEQ ID NO: 200431 - protein, 10 aa, Mycobacterium tuberculosis
VMPVGGQSSF

SEQ ID NO: 200432 - protein, 10 aa, Mycobacterium tuberculosis
MPVGGQSSFY

SEQ ID NO: 200433 - protein, 10 aa, Mycobacterium tuberculosis
GQSSFYSDWY

SEQ ID NO: 200434 - protein, 10 aa, Mycobacterium tuberculosis
FYSDWYQPAC

SEQ ID NO: 200435 - protein, 10 aa, Mycobacterium tuberculosis
YQPACGKAGC

SEQ ID NO: 200436 - protein, 10 aa, Mycobacterium tuberculosis
CQTYKWETFL

SEQ ID NO: 200437 - protein, 10 aa, Mycobacterium tuberculosis
QTYKWETFLT

SEQ ID NO: 200438 - protein, 10 aa, Mycobacterium tuberculosis
TFLTSELPGW

SEQ ID NO: 200439 - protein, 10 aa, Mycobacterium tuberculosis
FLTSELPGWL

SEQ ID NO: 200440 - protein, 10 aa, Mycobacterium tuberculosis
ELPGWLQANR

SEQ ID NO: 200441 - protein, 10 aa, Mycobacterium tuberculosis
LPGWLQANRH

SEQ ID NO: 200442 - protein, 10 aa, Mycobacterium tuberculosis
GWLQANRHVK

SEQ ID NO: 200443 - protein, 10 aa, Mycobacterium tuberculosis
HVKPTGSAVV

SEQ ID NO: 200444 - protein, 10 aa, Mycobacterium tuberculosis
KPTGSAVVGL

SEQ ID NO: 200445 - protein, 10 aa, Mycobacterium tuberculosis
SAVVGLSMAA

SEQ ID NO: 200446 - protein, 10 aa, Mycobacterium tuberculosis
GLSMAASSAL

SEQ ID NO: 200447 - protein, 10 aa, Mycobacterium tuberculosis
SMAASSALTL

SEQ ID NO: 200448 - protein, 10 aa, Mycobacterium tuberculosis
MAASSALTLA

SEQ ID NO: 200449 - protein, 10 aa, Mycobacterium tuberculosis
AASSALTLAI

SEQ ID NO: 200450 - protein, 10 aa, Mycobacterium tuberculosis
ASSALTLAIY

SEQ ID NO: 200451 - protein, 10 aa, Mycobacterium tuberculosis
ALTLAIYHPQ

SEQ ID NO: 200452 - protein, 10 aa, Mycobacterium tuberculosis
TLAIYHPQQF

SEQ ID NO: 200453 - protein, 10 aa, Mycobacterium tuberculosis
LAIYHPQQFV

SEQ ID NO: 200454 - protein, 10 aa, Mycobacterium tuberculosis
AIYHPQQFVY

SEQ ID NO: 200455 - protein, 10 aa, Mycobacterium tuberculosis
HPQQFVYAGA

SEQ ID NO: 200456 - protein, 10 aa, Mycobacterium tuberculosis
FVYAGAMSGL

SEQ ID NO: 200457 - protein, 10 aa, Mycobacterium tuberculosis
VYAGAMSGLL

SEQ ID NO: 200458 - protein, 10 aa, Mycobacterium tuberculosis
AMSGLLDPSQ

SEQ ID NO: 200459 - protein, 10 aa, Mycobacterium tuberculosis
GLLDPSQAMG

SEQ ID NO: 200460 - protein, 10 aa, Mycobacterium tuberculosis
LLDPSQAMGP

SEQ ID NO: 200461 - protein, 10 aa, Mycobacterium tuberculosis
DPSQAMGPTL

SEQ ID NO: 200462 - protein, 10 aa, Mycobacterium tuberculosis
QAMGPTLIGL

SEQ ID NO: 200463 - protein, 10 aa, Mycobacterium tuberculosis
AMGPTLIGLA

SEQ ID NO: 200464 - protein, 10 aa, Mycobacterium tuberculosis
TLIGLAMGDA

SEQ ID NO: 200465 - protein, 10 aa, Mycobacterium tuberculosis
GLAMGDAGGY

SEQ ID NO: 200466 - protein, 10 aa, Mycobacterium tuberculosis
LAMGDAGGYK

SEQ ID NO: 200467 - protein, 10 aa, Mycobacterium tuberculosis
AMGDAGGYKA

SEQ ID NO: 200468 - protein, 10 aa, Mycobacterium tuberculosis
DMWGPKEDPA

SEQ ID NO: 200469 - protein, 10 aa, Mycobacterium tuberculosis
DPAWQRNDPL

SEQ ID NO: 200470 - protein, 10 aa, Mycobacterium tuberculosis
WQRNDPLLNV

SEQ ID NO: 200471 - protein, 10 aa, Mycobacterium tuberculosis
PLLNVGKLIA

SEQ ID NO: 200472 - protein, 10 aa, Mycobacterium tuberculosis
KLIANNTRVW

SEQ ID NO: 200473 - protein, 10 aa, Mycobacterium tuberculosis
LIANNTRVWV

SEQ ID NO: 200474 - protein, 10 aa, Mycobacterium tuberculosis
IANNTRVWVY

SEQ ID NO: 200475 - protein, 10 aa, Mycobacterium tuberculosis
RVWVYCGNGK

SEQ ID NO: 200476 - protein, 10 aa, Mycobacterium tuberculosis
KPSDLGGNNL

SEQ ID NO: 200477 - protein, 10 aa, Mycobacterium tuberculosis
LPAKFLEGFV

SEQ ID NO: 200478 - protein, 10 aa, Mycobacterium tuberculosis
PAKFLEGFVR

SEQ ID NO: 200479 - protein, 10 aa, Mycobacterium tuberculosis
EGFVRTSNIK

SEQ ID NO: 200480 - protein, 10 aa, Mycobacterium tuberculosis
GFVRTSNIKF

SEQ ID NO: 200481 - protein, 10 aa, Mycobacterium tuberculosis
TSNIKFQDAY

SEQ ID NO: 200482 - protein, 10 aa, Mycobacterium tuberculosis
YNAGGGHNGV

SEQ ID NO: 200483 - protein, 10 aa, Mycobacterium tuberculosis
NAGGGHNGVF

SEQ ID NO: 200484 - protein, 10 aa, Mycobacterium tuberculosis
GVFDFPDSGT

SEQ ID NO: 200485 - protein, 10 aa, Mycobacterium tuberculosis
DSGTHSWEYW

SEQ ID NO: 200486 - protein, 10 aa, Mycobacterium tuberculosis
HSWEYWGAQL

SEQ ID NO: 200487 - protein, 10 aa, Mycobacterium tuberculosis
WEYWGAQLNA

SEQ ID NO: 200488 - protein, 10 aa, Mycobacterium tuberculosis
EYWGAQLNAM

SEQ ID NO: 200489 - protein, 10 aa, Mycobacterium tuberculosis
AQLNAMKPDL

SEQ ID NO: 200490 - protein, 10 aa, Mycobacterium tuberculosis
NAMKPDLQRA

SEQ ID NO: 200491 - protein, 10 aa, Mycobacterium tuberculosis
AMKPDLQRAL

SEQ ID NO: 200492 - protein, 10 aa, Mycobacterium tuberculosis
LGATPNTGPA

SEQ ID NO: 200493 - protein, 11 aa, Mycobacterium tuberculosis
MQLVDRVRGAV

SEQ ID NO: 200494 - protein, 11 aa, Mycobacterium tuberculosis
RVRGAVTGMSR

SEQ ID NO: 200495 - protein, 11 aa, Mycobacterium tuberculosis
GAVTGMSRRLV

SEQ ID NO: 200496 - protein, 11 aa, Mycobacterium tuberculosis
AVTGMSRRLVV

SEQ ID NO: 200497 - protein, 11 aa, Mycobacterium tuberculosis
GMSRRLVVGAV

SEQ ID NO: 200498 - protein, 11 aa, Mycobacterium tuberculosis
RRLVVGAVGAA

SEQ ID NO: 200499 - protein, 11 aa, Mycobacterium tuberculosis
RLVVGAVGAAL

SEQ ID NO: 200500 - protein, 11 aa, Mycobacterium tuberculosis
LVVGAVGAALV

SEQ ID NO: 200501 - protein, 11 aa, Mycobacterium tuberculosis
GAVGAALVSGL

SEQ ID NO: 200502 - protein, 11 aa, Mycobacterium tuberculosis
AVGAALVSGLV

SEQ ID NO: 200503 - protein, 11 aa, Mycobacterium tuberculosis
AALVSGLVGAV

SEQ ID NO: 200504 - protein, 11 aa, Mycobacterium tuberculosis
GLVGAVGGTAT

SEQ ID NO: 200505 - protein, 11 aa, Mycobacterium tuberculosis
LVGAVGGTATA

SEQ ID NO: 200506 - protein, 11 aa, Mycobacterium tuberculosis
GAVGGTATAGA

SEQ ID NO: 200507 - protein, 11 aa, Mycobacterium tuberculosis
AVGGTATAGAF

SEQ ID NO: 200508 - protein, 11 aa, Mycobacterium tuberculosis
ATAGAFSRPGL

SEQ ID NO: 200509 - protein, 11 aa, Mycobacterium tuberculosis
AFSRPGLPVEY

SEQ ID NO: 200510 - protein, 11 aa, Mycobacterium tuberculosis
FSRPGLPVEYL

SEQ ID NO: 200511 - protein, 11 aa, Mycobacterium tuberculosis
RPGLPVEYLQV

SEQ ID NO: 200512 - protein, 11 aa, Mycobacterium tuberculosis
LPVEYLQVPSP

SEQ ID NO: 200513 - protein, 11 aa, Mycobacterium tuberculosis
VEYLQVPSPSM

SEQ ID NO: 200514 - protein, 11 aa, Mycobacterium tuberculosis
YLQVPSPSMGR

SEQ ID NO: 200515 - protein, 11 aa, Mycobacterium tuberculosis
SMGRDIKVQFQ

SEQ ID NO: 200516 - protein, 11 aa, Mycobacterium tuberculosis
FQSGGANSPAL

SEQ ID NO: 200517 - protein, 11 aa, Mycobacterium tuberculosis
QSGGANSPALY

SEQ ID NO: 200518 - protein, 11 aa, Mycobacterium tuberculosis
GGANSPALYLL

SEQ ID NO: 200519 - protein, 11 aa, Mycobacterium tuberculosis
NSPALYLLDGL

SEQ ID NO: 200520 - protein, 11 aa, Mycobacterium tuberculosis
SPALYLLDGLR

SEQ ID NO: 200521 - protein, 11 aa, Mycobacterium tuberculosis
ALYLLDGLRAQ

SEQ ID NO: 200522 - protein, 11 aa, Mycobacterium tuberculosis
YLLDGLRAQDD

SEQ ID NO: 200523 - protein, 11 aa, Mycobacterium tuberculosis
LLDGLRAQDDF

SEQ ID NO: 200524 - protein, 11 aa, Mycobacterium tuberculosis
FSGWDINTPAF

SEQ ID NO: 200525 - protein, 11 aa, Mycobacterium tuberculosis
GWDINTPAFEW

SEQ ID NO: 200526 - protein, 11 aa, Mycobacterium tuberculosis
FEWYDQSGLSV

SEQ ID NO: 200527 - protein, 11 aa, Mycobacterium tuberculosis
WYDQSGLSVVM

SEQ ID NO: 200528 - protein, 11 aa, Mycobacterium tuberculosis
DQSGLSVVMPV

SEQ ID NO: 200529 - protein, 11 aa, Mycobacterium tuberculosis
VVMPVGGQSSF

SEQ ID NO: 200530 - protein, 11 aa, Mycobacterium tuberculosis
VMPVGGQSSFY

SEQ ID NO: 200531 - protein, 11 aa, Mycobacterium tuberculosis
MPVGGQSSFYS

SEQ ID NO: 200532 - protein, 11 aa, Mycobacterium tuberculosis
VGGQSSFYSDW

SEQ ID NO: 200533 - protein, 11 aa, Mycobacterium tuberculosis
SSFYSDWYQPA

SEQ ID NO: 200534 - protein, 11 aa, Mycobacterium tuberculosis
YSDWYQPACGK

SEQ ID NO: 200535 - protein, 11 aa, Mycobacterium tuberculosis
ACGKAGCQTYK

SEQ ID NO: 200536 - protein, 11 aa, Mycobacterium tuberculosis
CQTYKWETFLT

SEQ ID NO: 200537 - protein, 11 aa, Mycobacterium tuberculosis
YKWETFLTSEL

SEQ ID NO: 200538 - protein, 11 aa, Mycobacterium tuberculosis
ETFLTSELPGW

SEQ ID NO: 200539 - protein, 11 aa, Mycobacterium tuberculosis
TFLTSELPGWL

SEQ ID NO: 200540 - protein, 11 aa, Mycobacterium tuberculosis
FLTSELPGWLQ

SEQ ID NO: 200541 - protein, 11 aa, Mycobacterium tuberculosis
LPGWLQANRHV

SEQ ID NO: 200542 - protein, 11 aa, Mycobacterium tuberculosis
VVGLSMAASSA

SEQ ID NO: 200543 - protein, 11 aa, Mycobacterium tuberculosis
GLSMAASSALT

SEQ ID NO: 200544 - protein, 11 aa, Mycobacterium tuberculosis
LSMAASSALTL

SEQ ID NO: 200545 - protein, 11 aa, Mycobacterium tuberculosis
SMAASSALTLA

SEQ ID NO: 200546 - protein, 11 aa, Mycobacterium tuberculosis
MAASSALTLAI

SEQ ID NO: 200547 - protein, 11 aa, Mycobacterium tuberculosis
AASSALTLAIY

SEQ ID NO: 200548 - protein, 11 aa, Mycobacterium tuberculosis
ASSALTLAIYH

SEQ ID NO: 200549 - protein, 11 aa, Mycobacterium tuberculosis
ALTLAIYHPQQ

SEQ ID NO: 200550 - protein, 11 aa, Mycobacterium tuberculosis
LTLAIYHPQQF

SEQ ID NO: 200551 - protein, 11 aa, Mycobacterium tuberculosis
TLAIYHPQQFV

SEQ ID NO: 200552 - protein, 11 aa, Mycobacterium tuberculosis
LAIYHPQQFVY

SEQ ID NO: 200553 - protein, 11 aa, Mycobacterium tuberculosis
AIYHPQQFVYA

SEQ ID NO: 200554 - protein, 11 aa, Mycobacterium tuberculosis
HPQQFVYAGAM

SEQ ID NO: 200555 - protein, 11 aa, Mycobacterium tuberculosis
FVYAGAMSGLL

SEQ ID NO: 200556 - protein, 11 aa, Mycobacterium tuberculosis
AMSGLLDPSQA

SEQ ID NO: 200557 - protein, 11 aa, Mycobacterium tuberculosis
MSGLLDPSQAM

SEQ ID NO: 200558 - protein, 11 aa, Mycobacterium tuberculosis
GLLDPSQAMGP

SEQ ID NO: 200559 - protein, 11 aa, Mycobacterium tuberculosis
LLDPSQAMGPT

SEQ ID NO: 200560 - protein, 11 aa, Mycobacterium tuberculosis
SQAMGPTLIGL

SEQ ID NO: 200561 - protein, 11 aa, Mycobacterium tuberculosis
QAMGPTLIGLA

SEQ ID NO: 200562 - protein, 11 aa, Mycobacterium tuberculosis
AMGPTLIGLAM

SEQ ID NO: 200563 - protein, 11 aa, Mycobacterium tuberculosis
GLAMGDAGGYK

SEQ ID NO: 200564 - protein, 11 aa, Mycobacterium tuberculosis
GYKASDMWGPK

SEQ ID NO: 200565 - protein, 11 aa, Mycobacterium tuberculosis
DPAWQRNDPLL

SEQ ID NO: 200566 - protein, 11 aa, Mycobacterium tuberculosis
QRNDPLLNVGK

SEQ ID NO: 200567 - protein, 11 aa, Mycobacterium tuberculosis
NVGKLIANNTR

SEQ ID NO: 200568 - protein, 11 aa, Mycobacterium tuberculosis
KLIANNTRVWV

SEQ ID NO: 200569 - protein, 11 aa, Mycobacterium tuberculosis
LIANNTRVWVY

SEQ ID NO: 200570 - protein, 11 aa, Mycobacterium tuberculosis
VYCGNGKPSDL

SEQ ID NO: 200571 - protein, 11 aa, Mycobacterium tuberculosis
NLPAKFLEGFV

SEQ ID NO: 200572 - protein, 11 aa, Mycobacterium tuberculosis
LPAKFLEGFVR

SEQ ID NO: 200573 - protein, 11 aa, Mycobacterium tuberculosis
FLEGFVRTSNI

SEQ ID NO: 200574 - protein, 11 aa, Mycobacterium tuberculosis
RTSNIKFQDAY

SEQ ID NO: 200575 - protein, 11 aa, Mycobacterium tuberculosis
YNAGGGHNGVF

SEQ ID NO: 200576 - protein, 11 aa, Mycobacterium tuberculosis
FPDSGTHSWEY

SEQ ID NO: 200577 - protein, 11 aa, Mycobacterium tuberculosis
THSWEYWGAQL

SEQ ID NO: 200578 - protein, 11 aa, Mycobacterium tuberculosis
WEYWGAQLNAM

SEQ ID NO: 200579 - protein, 11 aa, Mycobacterium tuberculosis
EYWGAQLNAMK

SEQ ID NO: 200580 - protein, 11 aa, Mycobacterium tuberculosis
QLNAMKPDLQR

SEQ ID NO: 200581 - protein, 11 aa, Mycobacterium tuberculosis
KPDLQRALGAT

SEQ ID NO: 200582 - protein, 11 aa, Mycobacterium tuberculosis
ALGATPNTGPA

SEQ ID NO: 200583 - protein, 11 aa, Mycobacterium tuberculosis
TPNTGPAPQGA

SEQ ID NO: 200584 - protein, 100 aa, Mycobacterium tuberculosis; identical to SEQ ID NO: 72

SEQ ID NO: 200585 - protein, 8 aa, Mycobacterium tuberculosis
AEMKTDAA

SEQ ID NO: 200586 - protein, 8 aa, Mycobacterium tuberculosis
KTDAATLA

SEQ ID NO: 200587 - protein, 8 aa, Mycobacterium tuberculosis
LAQEAGNF

SEQ ID NO: 200588 - protein, 8 aa, Mycobacterium tuberculosis
QEAGNFER

SEQ ID NO: 200589 - protein, 8 aa, Mycobacterium tuberculosis
EAGNFERI

SEQ ID NO: 200590 - protein, 8 aa, Mycobacterium tuberculosis
FERISGDL

SEQ ID NO: 200591 - protein, 8 aa, Mycobacterium tuberculosis
TQIDQVES

SEQ ID NO: 200592 - protein, 8 aa, Mycobacterium tuberculosis
VESTAGSL

SEQ ID NO: 200593 - protein, 8 aa, Mycobacterium tuberculosis
GSLQGQWR

SEQ ID NO: 200594 - protein, 8 aa, Mycobacterium tuberculosis
SLQGQWRG

SEQ ID NO: 200595 - protein, 8 aa, Mycobacterium tuberculosis
LQGQWRGA

SEQ ID NO: 200596 - protein, 8 aa, Mycobacterium tuberculosis
GTAAQAAV

SEQ ID NO: 200597 - protein, 8 aa, Mycobacterium tuberculosis
TAAQAAVV

SEQ ID NO: 200598 - protein, 8 aa, Mycobacterium tuberculosis
AAQAAVVR

SEQ ID NO: 200599 - protein, 8 aa, Mycobacterium tuberculosis
AQAAVVRF

SEQ ID NO: 200600 - protein, 8 aa, Mycobacterium tuberculosis
AVVRFQEA

SEQ ID NO: 200601 - protein, 8 aa, Mycobacterium tuberculosis
RFQEAANK

SEQ ID NO: 200602 - protein, 8 aa, Mycobacterium tuberculosis
ELDEISTN

SEQ ID NO: 200603 - protein, 8 aa, Mycobacterium tuberculosis
RQAGVQYS

SEQ ID NO: 200604 - protein, 8 aa, Mycobacterium tuberculosis
QAGVQYSR

SEQ ID NO: 200605 - protein, 8 aa, Mycobacterium tuberculosis
DEEQQQAL

SEQ ID NO: 200606 - protein, 8 aa, Mycobacterium tuberculosis
QQALSSQM

SEQ ID NO: 200607 - protein, 8 aa, Mycobacterium tuberculosis
ALSSQMGF

SEQ ID NO: 200608 - protein, 9 aa, Mycobacterium tuberculosis
MAEMKTDAA

SEQ ID NO: 200609 - protein, 9 aa, Mycobacterium tuberculosis
AEMKTDAAT

SEQ ID NO: 200610 - protein, 9 aa, Mycobacterium tuberculosis
EMKTDAATL

SEQ ID NO: 200611 - protein, 9 aa, Mycobacterium tuberculosis
DAATLAQEA

SEQ ID NO: 200612 - protein, 9 aa, Mycobacterium tuberculosis
AQEAGNFER

SEQ ID NO: 200613 - protein, 9 aa, Mycobacterium tuberculosis
QEAGNFERI

SEQ ID NO: 200614 - protein, 9 aa, Mycobacterium tuberculosis
DLKTQIDQV

SEQ ID NO: 200615 - protein, 9 aa, Mycobacterium tuberculosis
TQIDQVEST

SEQ ID NO: 200616 - protein, 9 aa, Mycobacterium tuberculosis
QIDQVESTA

SEQ ID NO: 200617 - protein, 9 aa, Mycobacterium tuberculosis
TAGSLQGQW

SEQ ID NO: 200618 - protein, 9 aa, Mycobacterium tuberculosis
SLQGQWRGA

SEQ ID NO: 200619 - protein, 9 aa, Mycobacterium tuberculosis
LQGQWRGAA

SEQ ID NO: 200620 - protein, 9 aa, Mycobacterium tuberculosis
GQWRGAAGT

SEQ ID NO: 200621 - protein, 9 aa, Mycobacterium tuberculosis
GTAAQAAVV

SEQ ID NO: 200622 - protein, 9 aa, Mycobacterium tuberculosis
TAAQAAVVR

SEQ ID NO: 200623 - protein, 9 aa, Mycobacterium tuberculosis
AAQAAVVRF

SEQ ID NO: 200624 - protein, 9 aa, Mycobacterium tuberculosis
AAVVRFQEA

SEQ ID NO: 200625 - protein, 9 aa, Mycobacterium tuberculosis
VRFQEAANK

SEQ ID NO: 200626 - protein, 9 aa, Mycobacterium tuberculosis
KQKQELDEI

SEQ ID NO: 200627 - protein, 9 aa, Mycobacterium tuberculosis
ELDEISTNI

SEQ ID NO: 200628 - protein, 9 aa, Mycobacterium tuberculosis
STNIRQAGV

SEQ ID NO: 200629 - protein, 9 aa, Mycobacterium tuberculosis
RQAGVQYSR

SEQ ID NO: 200630 - protein, 9 aa, Mycobacterium tuberculosis
RADEEQQQA

SEQ ID NO: 200631 - protein, 9 aa, Mycobacterium tuberculosis
EEQQQALSS

SEQ ID NO: 200632 - protein, 9 aa, Mycobacterium tuberculosis
QQQALSSQM

SEQ ID NO: 200633 - protein, 9 aa, Mycobacterium tuberculosis
QALSSQMGF

SEQ ID NO: 200634 - protein, 10 aa, Mycobacterium tuberculosis
MAEMKTDAAT

SEQ ID NO: 200635 - protein, 10 aa, Mycobacterium tuberculosis
AEMKTDAATL

SEQ ID NO: 200636 - protein, 10 aa, Mycobacterium tuberculosis
ATLAQEAGNF

SEQ ID NO: 200637 - protein, 10 aa, Mycobacterium tuberculosis
LAQEAGNFER

SEQ ID NO: 200638 - protein, 10 aa, Mycobacterium tuberculosis
AQEAGNFERI

SEQ ID NO: 200639 - protein, 10 aa, Mycobacterium tuberculosis
RISGDLKTQI

SEQ ID NO: 200640 - protein, 10 aa, Mycobacterium tuberculosis
TQIDQVESTA

SEQ ID NO: 200641 - protein, 10 aa, Mycobacterium tuberculosis
STAGSLQGQW

SEQ ID NO: 200642 - protein, 10 aa, Mycobacterium tuberculosis
TAGSLQGQWR

SEQ ID NO: 200643 - protein, 10 aa, Mycobacterium tuberculosis
SLQGQWRGAA

SEQ ID NO: 200644 - protein, 10 aa, Mycobacterium tuberculosis
GQWRGAAGTA

SEQ ID NO: 200645 - protein, 10 aa, Mycobacterium tuberculosis
AAGTAAQAAV

SEQ ID NO: 200646 - protein, 10 aa, Mycobacterium tuberculosis
GTAAQAAVVR

SEQ ID NO: 200647 - protein, 10 aa, Mycobacterium tuberculosis
TAAQAAVVRF

SEQ ID NO: 200648 - protein, 10 aa, Mycobacterium tuberculosis
QAAVVRFQEA

SEQ ID NO: 200649 - protein, 10 aa, Mycobacterium tuberculosis
AAVVRFQEAA

SEQ ID NO: 200650 - protein, 10 aa, Mycobacterium tuberculosis
VVRFQEAANK

SEQ ID NO: 200651 - protein, 10 aa, Mycobacterium tuberculosis
RFQEAANKQK

SEQ ID NO: 200652 - protein, 10 aa, Mycobacterium tuberculosis
EAANKQKQEL

SEQ ID NO: 200653 - protein, 10 aa, Mycobacterium tuberculosis
ELDEISTNIR

SEQ ID NO: 200654 - protein, 10 aa, Mycobacterium tuberculosis
ISTNIRQAGV

SEQ ID NO: 200655 - protein, 10 aa, Mycobacterium tuberculosis
RQAGVQYSRA

SEQ ID NO: 200656 - protein, 10 aa, Mycobacterium tuberculosis
RADEEQQQAL

SEQ ID NO: 200657 - protein, 10 aa, Mycobacterium tuberculosis
QQALSSQMGF

SEQ ID NO: 200658 - protein, 11 aa, Mycobacterium tuberculosis
MAEMKTDAATL

SEQ ID NO: 200659 - protein, 11 aa, Mycobacterium tuberculosis
AEMKTDAATLA

SEQ ID NO: 200660 - protein, 11 aa, Mycobacterium tuberculosis
KTDAATLAQEA

SEQ ID NO: 200661 - protein, 11 aa, Mycobacterium tuberculosis
TLAQEAGNFER

SEQ ID NO: 200662 - protein, 11 aa, Mycobacterium tuberculosis
ESTAGSLQGQW

SEQ ID NO: 200663 - protein, 11 aa, Mycobacterium tuberculosis
STAGSLQGQWR

SEQ ID NO: 200664 - protein, 11 aa, Mycobacterium tuberculosis
LQGQWRGAAGT

SEQ ID NO: 200665 - protein, 11 aa, Mycobacterium tuberculosis
GQWRGAAGTAA

SEQ ID NO: 200666 - protein, 11 aa, Mycobacterium tuberculosis
GAAGTAAQAAV

SEQ ID NO: 200667 - protein, 11 aa, Mycobacterium tuberculosis
GTAAQAAVVRF

SEQ ID NO: 200668 - protein, 11 aa, Mycobacterium tuberculosis
TAAQAAVVRFQ

SEQ ID NO: 200669 - protein, 11 aa, Mycobacterium tuberculosis
AQAAVVRFQEA

SEQ ID NO: 200670 - protein, 11 aa, Mycobacterium tuberculosis
QAAVVRFQEAA

SEQ ID NO: 200671 - protein, 11 aa, Mycobacterium tuberculosis
AVVRFQEAANK

SEQ ID NO: 200672 - protein, 11 aa, Mycobacterium tuberculosis
QEAANKQKQEL

SEQ ID NO: 200673 - protein, 11 aa, Mycobacterium tuberculosis
KQELDEISTNI

SEQ ID NO: 200674 - protein, 11 aa, Mycobacterium tuberculosis
ELDEISTNIRQ

SEQ ID NO: 200675 - protein, 11 aa, Mycobacterium tuberculosis
EISTNIRQAGV

SEQ ID NO: 200676 - protein, 11 aa, Mycobacterium tuberculosis
STNIRQAGVQY

SEQ ID NO: 200677 - protein, 11 aa, Mycobacterium tuberculosis
NIRQAGVQYSR

SEQ ID NO: 200678 - protein, 11 aa, Mycobacterium tuberculosis
SRADEEQQQAL

SEQ ID NO: 200679 - protein, 11 aa, Mycobacterium tuberculosis
EEQQQALSSQM

SEQ ID NO: 200680 - protein, 11 aa, Mycobacterium tuberculosis
QQQALSSQMGF

SEQ ID NO: 200681 - protein, 8 aa, Homo Sapiens
HLADSPAV

SEQ ID NO: 200682 - protein, 8 aa, Homo Sapiens
FLTGMTVA

SEQ ID NO: 200683 - protein, 8 aa, Homo Sapiens
AAWMATYL

SEQ ID NO: 200684 - protein, 8 aa, Homo Sapiens
VLVSRIAA

SEQ ID NO: 200685 - protein, 8 aa, Homo Sapiens
YQSFEQVV

SEQ ID NO: 200686 - protein, 8 aa, Homo Sapiens
GALCVESV

SEQ ID NO: 200687 - protein, 8 aa, Homo Sapiens
VLLGSLFS

SEQ ID NO: 200688 - protein, 8 aa, Homo Sapiens
FLTGMTVA

SEQ ID NO: 200689 - protein, 8 aa, Homo Sapiens
HLADSPAV

SEQ ID NO: 200690 - protein, 8 aa, Homo Sapiens
YQSFEQVV

SEQ ID NO: 200691 - protein, 8 aa, Homo Sapiens
TVAGVVLL

SEQ ID NO: 200692 - protein, 8 aa, Homo Sapiens
FLSYKLSQ

SEQ ID NO: 200693 - protein, 8 aa, Homo Sapiens
MAAVKQAL

SEQ ID NO: 200694 - protein, 8 aa, Homo Sapiens
SLDAREVI

SEQ ID NO: 200695 - protein, 8 aa, Homo Sapiens
ELYGNNAA

SEQ ID NO: 200696 - protein, 8 aa, Homo Sapiens
MTVAGVVL

SEQ ID NO: 200697 - protein, 8 aa, Homo Sapiens
VLVSRIAA

SEQ ID NO: 200698 - protein, 8 aa, Homo Sapiens
SQSNRELV

SEQ ID NO: 200699 - protein, 8 aa, Homo Sapiens
FLTGMTVA

SEQ ID NO: 200700 - protein, 8 aa, Homo Sapiens
HLADSPAV

SEQ ID NO: 200701 - protein, 8 aa, Homo Sapiens
VLVSRIAA

SEQ ID NO: 200702 - protein, 8 aa, Homo Sapiens
MQVLVSRI

SEQ ID NO: 200703 - protein, 8 aa, Homo Sapiens
FLSYKLSQ

SEQ ID NO: 200704 - protein, 8 aa, Homo Sapiens
GVNWGRIV

SEQ ID NO: 200705 - protein, 8 aa, Homo Sapiens
GMTVAGVV

SEQ ID NO: 200706 - protein, 8 aa, Homo Sapiens
YQSFEQVV

SEQ ID NO: 200707 - protein, 8 aa, Homo Sapiens
RIAAWMAT

SEQ ID NO: 200708 - protein, 8 aa, Homo Sapiens
EVIPMAAV

SEQ ID NO: 200709 - protein, 8 aa, Homo Sapiens
SQSNRELV

SEQ ID NO: 200710 - protein, 8 aa, Homo Sapiens
MTVAGVVL

SEQ ID NO: 200711 - protein, 8 aa, Homo Sapiens
GALCVESV

SEQ ID NO: 200712 - protein, 8 aa, Homo Sapiens
GVVLLGSL

SEQ ID NO: 200713 - protein, 8 aa, Homo Sapiens
TVAGVVLL

SEQ ID NO: 200714 - protein, 8 aa, Homo Sapiens
HLADSPAV

SEQ ID NO: 200715 - protein, 8 aa, Homo Sapiens
SVDKEMQV

SEQ ID NO: 200716 - protein, 8 aa, Homo Sapiens
HLADSPAV

SEQ ID NO: 200717 - protein, 8 aa, Homo Sapiens
MQVLVSRI

SEQ ID NO: 200718 - protein, 8 aa, Homo Sapiens
FLTGMTVA

SEQ ID NO: 200719 - protein, 8 aa, Homo Sapiens
SQSNRELV

SEQ ID NO: 200720 - protein, 8 aa, Homo Sapiens
YQSFEQVV

SEQ ID NO: 200721 - protein, 8 aa, Homo Sapiens
RIVAFFSF

SEQ ID NO: 200722 - protein, 8 aa, Homo Sapiens
RIAAWMAT

SEQ ID NO: 200723 - protein, 8 aa, Homo Sapiens
GALCVESV

SEQ ID NO: 200724 - protein, 8 aa, Homo Sapiens
AAWMATYL

SEQ ID NO: 200725 - protein, 8 aa, Homo Sapiens
MTVAGVVL

SEQ ID NO: 200726 - protein, 8 aa, Homo Sapiens
VLVSRIAA

SEQ ID NO: 200727 - protein, 8 aa, Homo Sapiens
SEMETPSA

SEQ ID NO: 200728 - protein, 8 aa, Homo Sapiens
EVIPMAAV

SEQ ID NO: 200729 - protein, 8 aa, Homo Sapiens
SVDKEMQV

SEQ ID NO: 200730 - protein, 8 aa, Homo Sapiens
HLADSPAV

SEQ ID NO: 200731 - protein, 8 aa, Homo Sapiens
SVDKEMQV

SEQ ID NO: 200732 - protein, 8 aa, Homo Sapiens
FLTGMTVA

SEQ ID NO: 200733 - protein, 8 aa, Homo Sapiens
SLDAREVI

SEQ ID NO: 200734 - protein, 8 aa, Homo Sapiens
ELYGNNAA

SEQ ID NO: 200735 - protein, 8 aa, Homo Sapiens
TVAGVVLL

SEQ ID NO: 200736 - protein, 8 aa, Homo Sapiens
YLNDHLEP

SEQ ID NO: 200737 - protein, 8 aa, Homo Sapiens
EVIPMAAV

SEQ ID NO: 200738 - protein, 8 aa, Homo Sapiens
GMTVAGVV

SEQ ID NO: 200739 - protein, 8 aa, Homo Sapiens
VLVSRIAA

SEQ ID NO: 200740 - protein, 8 aa, Homo Sapiens
VLLGSLFS

SEQ ID NO: 200741 - protein, 8 aa, Homo Sapiens
GVNWGRIV

SEQ ID NO: 200742 - protein, 8 aa, Homo Sapiens
WFLTGMTV

SEQ ID NO: 200743 - protein, 8 aa, Homo Sapiens
SFGGALCV

SEQ ID NO: 200744 - protein, 8 aa, Homo Sapiens
SSLDAREV

SEQ ID NO: 200745 - protein, 8 aa, Homo Sapiens
DLTSQLHI

SEQ ID NO: 200746 - protein, 8 aa, Homo Sapiens
YQSFEQVV

SEQ ID NO: 200747 - protein, 8 aa, Homo Sapiens
PMAAVKQA

SEQ ID NO: 200748 - protein, 8 aa, Homo Sapiens
FLSYKLSQ

SEQ ID NO: 200749 - protein, 8 aa, Homo Sapiens
AAWMATYL

SEQ ID NO: 200750 - protein, 8 aa, Homo Sapiens
SQSNRELV

SEQ ID NO: 200751 - protein, 8 aa, Homo Sapiens
GALCVESV

SEQ ID NO: 200752 - protein, 8 aa, Homo Sapiens
HLADSPAV

SEQ ID NO: 200753 - protein, 8 aa, Homo Sapiens
ELYGNNAA

SEQ ID NO: 200754 - protein, 8 aa, Homo Sapiens
FLTGMTVA

SEQ ID NO: 200755 - protein, 8 aa, Homo Sapiens
SVDKEMQV

SEQ ID NO: 200756 - protein, 8 aa, Homo Sapiens
SLDAREVI

SEQ ID NO: 200757 - protein, 8 aa, Homo Sapiens
VLVSRIAA

SEQ ID NO: 200758 - protein, 8 aa, Homo Sapiens
YLNDHLEP

SEQ ID NO: 200759 - protein, 8 aa, Homo Sapiens
YQSFEQVV

SEQ ID NO: 200760 - protein, 8 aa, Homo Sapiens
EVIPMAAV

SEQ ID NO: 200761 - protein, 8 aa, Homo Sapiens
VLLGSLFS

SEQ ID NO: 200762 - protein, 8 aa, Homo Sapiens
FLSYKLSQ

SEQ ID NO: 200763 - protein, 8 aa, Homo Sapiens
WFLTGMTV

SEQ ID NO: 200764 - protein, 8 aa, Homo Sapiens
GMTVAGVV

SEQ ID NO: 200765 - protein, 8 aa, Homo Sapiens
HLADSPAV

SEQ ID NO: 200766 - protein, 8 aa, Homo Sapiens
SVDKEMQV

SEQ ID NO: 200767 - protein, 8 aa, Homo Sapiens
FLTGMTVA

SEQ ID NO: 200768 - protein, 8 aa, Homo Sapiens
ELYGNNAA

SEQ ID NO: 200769 - protein, 8 aa, Homo Sapiens
EVIPMAAV

SEQ ID NO: 200770 - protein, 8 aa, Homo Sapiens
TVAGVVLL

SEQ ID NO: 200771 - protein, 8 aa, Homo Sapiens
SLDAREVI

SEQ ID NO: 200772 - protein, 8 aa, Homo Sapiens
SFGGALCV

SEQ ID NO: 200773 - protein, 8 aa, Homo Sapiens
GMTVAGVV

SEQ ID NO: 200774 - protein, 8 aa, Homo Sapiens
AAWMATYL

SEQ ID NO: 200775 - protein, 8 aa, Homo Sapiens
VLVSRIAA

SEQ ID NO: 200776 - protein, 8 aa, Homo Sapiens
WFLTGMTV

SEQ ID NO: 200777 - protein, 8 aa, Homo Sapiens
FLSYKLSQ

SEQ ID NO: 200778 - protein, 8 aa, Homo Sapiens
DLTSQLHI

SEQ ID NO: 200779 - protein, 8 aa, Homo Sapiens
GVNWGRIV

SEQ ID NO: 200780 - protein, 8 aa, Homo Sapiens
PMAAVKQA

SEQ ID NO: 200781 - protein, 8 aa, Homo Sapiens
AYQSFEQV

SEQ ID NO: 200782 - protein, 8 aa, Homo Sapiens
VLLGSLFS

SEQ ID NO: 200783 - protein, 8 aa, Homo Sapiens
GALCVESV

SEQ ID NO: 200784 - protein, 8 aa, Homo Sapiens
HLADSPAV

SEQ ID NO: 200785 - protein, 8 aa, Homo Sapiens
FLTGMTVA

SEQ ID NO: 200786 - protein, 8 aa, Homo Sapiens
SVDKEMQV

SEQ ID NO: 200787 - protein, 8 aa, Homo Sapiens
SLDAREVI

SEQ ID NO: 200788 - protein, 8 aa, Homo Sapiens
TVAGVVLL

SEQ ID NO: 200789 - protein, 8 aa, Homo Sapiens
ELYGNNAA

SEQ ID NO: 200790 - protein, 8 aa, Homo Sapiens
WFLTGMTV

SEQ ID NO: 200791 - protein, 8 aa, Homo Sapiens
AAWMATYL

SEQ ID NO: 200792 - protein, 8 aa, Homo Sapiens
DLTSQLHI

SEQ ID NO: 200793 - protein, 8 aa, Homo Sapiens
VLLGSLFS

SEQ ID NO: 200794 - protein, 8 aa, Homo Sapiens
LSYKLSQK

SEQ ID NO: 200795 - protein, 8 aa, Homo Sapiens
VVDFLSYK

SEQ ID NO: 200796 - protein, 8 aa, Homo Sapiens
LLGSLFSR

SEQ ID NO: 200797 - protein, 8 aa, Homo Sapiens
VVDFLSYK

SEQ ID NO: 200798 - protein, 8 aa, Homo Sapiens
LSYKLSQK

SEQ ID NO: 200799 - protein, 8 aa, Homo Sapiens
VIPMAAVK

SEQ ID NO: 200800 - protein, 8 aa, Homo Sapiens
QVVNELFR

SEQ ID NO: 200801 - protein, 8 aa, Homo Sapiens
LVVDFLSY

SEQ ID NO: 200802 - protein, 8 aa, Homo Sapiens
NAAAESRK

SEQ ID NO: 200803 - protein, 8 aa, Homo Sapiens
NWGRIVAF

SEQ ID NO: 200804 - protein, 8 aa, Homo Sapiens
RIVAFFSF

SEQ ID NO: 200805 - protein, 8 aa, Homo Sapiens
VVLLGSLF

SEQ ID NO: 200806 - protein, 8 aa, Homo Sapiens
NWGRIVAF

SEQ ID NO: 200807 - protein, 8 aa, Homo Sapiens
AYQSFEQV

SEQ ID NO: 200808 - protein, 8 aa, Homo Sapiens
EVIPMAAV

SEQ ID NO: 200809 - protein, 8 aa, Homo Sapiens
LVVDFLSY

SEQ ID NO: 200810 - protein, 8 aa, Homo Sapiens
EVIPMAAV

SEQ ID NO: 200811 - protein, 8 aa, Homo Sapiens
LVVDFLSY

SEQ ID NO: 200812 - protein, 8 aa, Homo Sapiens
HITPGTAY

SEQ ID NO: 200813 - protein, 8 aa, Homo Sapiens
ELRYRRAF

SEQ ID NO: 200814 - protein, 8 aa, Homo Sapiens
RIVAFFSF

SEQ ID NO: 200815 - protein, 8 aa, Homo Sapiens
HITPGTAY

SEQ ID NO: 200816 - protein, 8 aa, Homo Sapiens
LVVDFLSY

SEQ ID NO: 200817 - protein, 8 aa, Homo Sapiens
KGQERFNR

SEQ ID NO: 200818 - protein, 8 aa, Homo Sapiens
LLGSLFSR

SEQ ID NO: 200819 - protein, 8 aa, Homo Sapiens
EMQVLVSR

SEQ ID NO: 200820 - protein, 8 aa, Homo Sapiens
HSSSLDAR

SEQ ID NO: 200821 - protein, 8 aa, Homo Sapiens
AAVKQALR

SEQ ID NO: 200822 - protein, 8 aa, Homo Sapiens
EFELRYRR

SEQ ID NO: 200823 - protein, 8 aa, Homo Sapiens
QVVNELFR

SEQ ID NO: 200824 - protein, 8 aa, Homo Sapiens
LSYKLSQK

SEQ ID NO: 200825 - protein, 8 aa, Homo Sapiens
EFELRYRR

SEQ ID NO: 200826 - protein, 8 aa, Homo Sapiens
EMQVLVSR

SEQ ID NO: 200827 - protein, 8 aa, Homo Sapiens
DEFELRYR

SEQ ID NO: 200828 - protein, 8 aa, Homo Sapiens
ESRKGQER

SEQ ID NO: 200829 - protein, 8 aa, Homo Sapiens
LLGSLFSR

SEQ ID NO: 200830 - protein, 8 aa, Homo Sapiens
HSSSLDAR

SEQ ID NO: 200831 - protein, 8 aa, Homo Sapiens
QVVNELFR

SEQ ID NO: 200832 - protein, 8 aa, Homo Sapiens
HSSSLDAR

SEQ ID NO: 200833 - protein, 8 aa, Homo Sapiens
NAAAESRK

SEQ ID NO: 200834 - protein, 8 aa, Homo Sapiens
LSYKLSQK

SEQ ID NO: 200835 - protein, 8 aa, Homo Sapiens
EMQVLVSR

SEQ ID NO: 200836 - protein, 8 aa, Homo Sapiens
NNAAAESR

SEQ ID NO: 200837 - protein, 8 aa, Homo Sapiens
AAVKQALR

SEQ ID NO: 200838 - protein, 8 aa, Homo Sapiens
ESRKGQER

SEQ ID NO: 200839 - protein, 8 aa, Homo Sapiens
IAAWMATY

SEQ ID NO: 200840 - protein, 8 aa, Homo Sapiens
EFELRYRR

SEQ ID NO: 200841 - protein, 8 aa, Homo Sapiens
TAYQSFEQ

SEQ ID NO: 200842 - protein, 8 aa, Homo Sapiens
VVDFLSYK

SEQ ID NO: 200843 - protein, 8 aa, Homo Sapiens
DEFELRYR

SEQ ID NO: 200844 - protein, 8 aa, Homo Sapiens
FSDVEENR

SEQ ID NO: 200845 - protein, 8 aa, Homo Sapiens
LLGSLFSR

SEQ ID NO: 200846 - protein, 8 aa, Homo Sapiens
EVIPMAAV

SEQ ID NO: 200847 - protein, 8 aa, Homo Sapiens
TVAGVVLL

SEQ ID NO: 200848 - protein, 8 aa, Homo Sapiens
TGMTVAGV

SEQ ID NO: 200849 - protein, 8 aa, Homo Sapiens
MTVAGVVL

SEQ ID NO: 200850 - protein, 8 aa, Homo Sapiens
MAAVKQAL

SEQ ID NO: 200851 - protein, 8 aa, Homo Sapiens
HLADSPAV

SEQ ID NO: 200852 - protein, 8 aa, Homo Sapiens
ERFNRWFL

SEQ ID NO: 200853 - protein, 8 aa, Homo Sapiens
DSPAVNGA

SEQ ID NO: 200854 - protein, 8 aa, Homo Sapiens
ELYGNNAA

SEQ ID NO: 200855 - protein, 8 aa, Homo Sapiens
EAGDEFEL

SEQ ID NO: 200856 - protein, 8 aa, Homo Sapiens
EVIPMAAV

SEQ ID NO: 200857 - protein, 8 aa, Homo Sapiens
HLADSPAV

SEQ ID NO: 200858 - protein, 8 aa, Homo Sapiens
ELYGNNAA

SEQ ID NO: 200859 - protein, 8 aa, Homo Sapiens
MTVAGVVL

SEQ ID NO: 200860 - protein, 8 aa, Homo Sapiens
TVAGVVLL

SEQ ID NO: 200861 - protein, 8 aa, Homo Sapiens
EAGDEFEL

SEQ ID NO: 200862 - protein, 8 aa, Homo Sapiens
SVDKEMQV

SEQ ID NO: 200863 - protein, 8 aa, Homo Sapiens
WFLTGMTV

SEQ ID NO: 200864 - protein, 8 aa, Homo Sapiens
SPAVNGAT

SEQ ID NO: 200865 - protein, 8 aa, Homo Sapiens
MAAVKQAL

SEQ ID NO: 200866 - protein, 8 aa, Homo Sapiens
AAWMATYL

SEQ ID NO: 200867 - protein, 8 aa, Homo Sapiens
ELRYRRAF

SEQ ID NO: 200868 - protein, 8 aa, Homo Sapiens
LVVDFLSY

SEQ ID NO: 200869 - protein, 8 aa, Homo Sapiens
RIVAFFSF

SEQ ID NO: 200870 - protein, 8 aa, Homo Sapiens
HITPGTAY

SEQ ID NO: 200871 - protein, 8 aa, Homo Sapiens
IAAWMATY

SEQ ID NO: 200872 - protein, 8 aa, Homo Sapiens
ELRYRRAF

SEQ ID NO: 200873 - protein, 8 aa, Homo Sapiens
VVLLGSLF

SEQ ID NO: 200874 - protein, 8 aa, Homo Sapiens
QERFNRWF

SEQ ID NO: 200875 - protein, 8 aa, Homo Sapiens
RELVVDFL

SEQ ID NO: 200876 - protein, 8 aa, Homo Sapiens
FEQVVNEL

SEQ ID NO: 200877 - protein, 8 aa, Homo Sapiens
NRWFLTGM

SEQ ID NO: 200878 - protein, 8 aa, Homo Sapiens
IAAWMATY

SEQ ID NO: 200879 - protein, 8 aa, Homo Sapiens
LVVDFLSY

SEQ ID NO: 200880 - protein, 8 aa, Homo Sapiens
MAAVKQAL

SEQ ID NO: 200881 - protein, 8 aa, Homo Sapiens
HITPGTAY

SEQ ID NO: 200882 - protein, 8 aa, Homo Sapiens
DAREVIPM

SEQ ID NO: 200883 - protein, 8 aa, Homo Sapiens
FFSFGGAL

SEQ ID NO: 200884 - protein, 8 aa, Homo Sapiens
SPAVNGAT

SEQ ID NO: 200885 - protein, 8 aa, Homo Sapiens
AAWMATYL

SEQ ID NO: 200886 - protein, 8 aa, Homo Sapiens
MTVAGVVL

SEQ ID NO: 200887 - protein, 8 aa, Homo Sapiens
RELVVDFL

SEQ ID NO: 200888 - protein, 8 aa, Homo Sapiens
FEQVVNEL

SEQ ID NO: 200889 - protein, 8 aa, Homo Sapiens
RELVVDFL

SEQ ID NO: 200890 - protein, 8 aa, Homo Sapiens
KEMQVLVS

SEQ ID NO: 200891 - protein, 8 aa, Homo Sapiens
REVIPMAA

SEQ ID NO: 200892 - protein, 8 aa, Homo Sapiens
LVSRIAAW

SEQ ID NO: 200893 - protein, 8 aa, Homo Sapiens
IAAWMATY

SEQ ID NO: 200894 - protein, 8 aa, Homo Sapiens
LSQKGYSW

SEQ ID NO: 200895 - protein, 8 aa, Homo Sapiens
KGYSWSQF

SEQ ID NO: 200896 - protein, 8 aa, Homo Sapiens
RIVAFFSF

SEQ ID NO: 200897 - protein, 8 aa, Homo Sapiens
AINGNPSW

SEQ ID NO: 200898 - protein, 9 aa, Homo Sapiens
FSDLTSQLH

SEQ ID NO: 200899 - protein, 9 aa, Homo Sapiens
FSFGGALCV

SEQ ID NO: 200900 - protein, 9 aa, Homo Sapiens
MTVAGVVLL

SEQ ID NO: 200901 - protein, 9 aa, Homo Sapiens
YLNDHLEPW

SEQ ID NO: 200902 - protein, 9 aa, Homo Sapiens
MTVAGVVLL

SEQ ID NO: 200903 - protein, 9 aa, Homo Sapiens
IAAWMATYL

SEQ ID NO: 200904 - protein, 9 aa, Homo Sapiens
FLTGMTVAG

SEQ ID NO: 200905 - protein, 9 aa, Homo Sapiens
FLSYKLSQK

SEQ ID NO: 200906 - protein, 9 aa, Homo Sapiens
LVSRIAAWM

SEQ ID NO: 200907 - protein, 9 aa, Homo Sapiens
VVDFLSYKL

SEQ ID NO: 200908 - protein, 9 aa, Homo Sapiens
ELYGNNAAA

SEQ ID NO: 200909 - protein, 9 aa, Homo Sapiens
PMAAVKQAL

SEQ ID NO: 200910 - protein, 9 aa, Homo Sapiens
GMTVAGVVL

SEQ ID NO: 200911 - protein, 9 aa, Homo Sapiens
LTGMTVAGV

SEQ ID NO: 200912 - protein, 9 aa, Homo Sapiens
MTVAGVVLL

SEQ ID NO: 200913 - protein, 9 aa, Homo Sapiens
IAAWMATYL

SEQ ID NO: 200914 - protein, 9 aa, Homo Sapiens
AVKQALREA

SEQ ID NO: 200915 - protein, 9 aa, Homo Sapiens
QLHITPGTA

SEQ ID NO: 200916 - protein, 9 aa, Homo Sapiens
YLNDHLEPW

SEQ ID NO: 200917 - protein, 9 aa, Homo Sapiens
TAYQSFEQV

SEQ ID NO: 200918 - protein, 9 aa, Homo Sapiens
FLSYKLSQK

SEQ ID NO: 200919 - protein, 9 aa, Homo Sapiens
LTGMTVAGV

SEQ ID NO: 200920 - protein, 9 aa, Homo Sapiens
MTVAGVVLL

SEQ ID NO: 200921 - protein, 9 aa, Homo Sapiens
SQLHITPGT

SEQ ID NO: 200922 - protein, 9 aa, Homo Sapiens
MTVAGVVLL

SEQ ID NO: 200923 - protein, 9 aa, Homo Sapiens
TAYQSFEQV

SEQ ID NO: 200924 - protein, 9 aa, Homo Sapiens
SQSNRELVV

SEQ ID NO: 200925 - protein, 9 aa, Homo Sapiens
FSFGGALCV

SEQ ID NO: 200926 - protein, 9 aa, Homo Sapiens
REVIPMAAV

SEQ ID NO: 200927 - protein, 9 aa, Homo Sapiens
IAAWMATYL

SEQ ID NO: 200928 - protein, 9 aa, Homo Sapiens
MQVLVSRIA

SEQ ID NO: 200929 - protein, 9 aa, Homo Sapiens
LTGMTVAGV

SEQ ID NO: 200930 - protein, 9 aa, Homo Sapiens
YLNDHLEPW

SEQ ID NO: 200931 - protein, 9 aa, Homo Sapiens
SEMETPSAI

SEQ ID NO: 200932 - protein, 9 aa, Homo Sapiens
ELYGNNAAA

SEQ ID NO: 200933 - protein, 9 aa, Homo Sapiens
FSFGGALCV

SEQ ID NO: 200934 - protein, 9 aa, Homo Sapiens
PMAAVKQAL

SEQ ID NO: 200935 - protein, 9 aa, Homo Sapiens
YLNDHLEPW

SEQ ID NO: 200936 - protein, 9 aa, Homo Sapiens
SVDKEMQVL

SEQ ID NO: 200937 - protein, 9 aa, Homo Sapiens
VVDFLSYKL

SEQ ID NO: 200938 - protein, 9 aa, Homo Sapiens
MTVAGVVLL

SEQ ID NO: 200939 - protein, 9 aa, Homo Sapiens
HITPGTAYQ

SEQ ID NO: 200940 - protein, 9 aa, Homo Sapiens
TAYQSFEQV

SEQ ID NO: 200941 - protein, 9 aa, Homo Sapiens
VLLGSLFSR

SEQ ID NO: 200942 - protein, 9 aa, Homo Sapiens
FLTGMTVAG

SEQ ID NO: 200943 - protein, 9 aa, Homo Sapiens
GVNWGRIVA

SEQ ID NO: 200944 - protein, 9 aa, Homo Sapiens
GMTVAGVVL

SEQ ID NO: 200945 - protein, 9 aa, Homo Sapiens
GGWDTFVEL

SEQ ID NO: 200946 - protein, 9 aa, Homo Sapiens
AFSDLTSQL

SEQ ID NO: 200947 - protein, 9 aa, Homo Sapiens
HLEPWIQEN

SEQ ID NO: 200948 - protein, 9 aa, Homo Sapiens
ELYGNNAAA

SEQ ID NO: 200949 - protein, 9 aa, Homo Sapiens
PMAAVKQAL

SEQ ID NO: 200950 - protein, 9 aa, Homo Sapiens
FSFGGALCV

SEQ ID NO: 200951 - protein, 9 aa, Homo Sapiens
YLNDHLEPW

SEQ ID NO: 200952 - protein, 9 aa, Homo Sapiens
VLLGSLFSR

SEQ ID NO: 200953 - protein, 9 aa, Homo Sapiens
VVDFLSYKL

SEQ ID NO: 200954 - protein, 9 aa, Homo Sapiens
SVDKEMQVL

SEQ ID NO: 200955 - protein, 9 aa, Homo Sapiens
FLTGMTVAG

SEQ ID NO: 200956 - protein, 9 aa, Homo Sapiens
AYQSFEQVV

SEQ ID NO: 200957 - protein, 9 aa, Homo Sapiens
ELYGNNAAA

SEQ ID NO: 200958 - protein, 9 aa, Homo Sapiens
PMAAVKQAL

SEQ ID NO: 200959 - protein, 9 aa, Homo Sapiens
FSFGGALCV

SEQ ID NO: 200960 - protein, 9 aa, Homo Sapiens
TAYQSFEQV

SEQ ID NO: 200961 - protein, 9 aa, Homo Sapiens
HITPGTAYQ

SEQ ID NO: 200962 - protein, 9 aa, Homo Sapiens
GMTVAGVVL

SEQ ID NO: 200963 - protein, 9 aa, Homo Sapiens
PMAAVKQAL

SEQ ID NO: 200964 - protein, 9 aa, Homo Sapiens
FSFGGALCV

SEQ ID NO: 200965 - protein, 9 aa, Homo Sapiens
ELYGNNAAA

SEQ ID NO: 200966 - protein, 9 aa, Homo Sapiens
TAYQSFEQV

SEQ ID NO: 200967 - protein, 9 aa, Homo Sapiens
YLNDHLEPW

SEQ ID NO: 200968 - protein, 9 aa, Homo Sapiens
VLLGSLFSR

SEQ ID NO: 200969 - protein, 9 aa, Homo Sapiens
LTGMTVAGV

SEQ ID NO: 200970 - protein, 9 aa, Homo Sapiens
LLGSLFSRK

SEQ ID NO: 200971 - protein, 9 aa, Homo Sapiens
FLSYKLSQK

SEQ ID NO: 200972 - protein, 9 aa, Homo Sapiens
RIAAWMATY

SEQ ID NO: 200973 - protein, 9 aa, Homo Sapiens
VLLGSLFSR

SEQ ID NO: 200974 - protein, 9 aa, Homo Sapiens
LVVDFLSYK

SEQ ID NO: 200975 - protein, 9 aa, Homo Sapiens
LVVDFLSYK

SEQ ID NO: 200976 - protein, 9 aa, Homo Sapiens
LLGSLFSRK

SEQ ID NO: 200977 - protein, 9 aa, Homo Sapiens
VLLGSLFSR

SEQ ID NO: 200978 - protein, 9 aa, Homo Sapiens
RIAAWMATY

SEQ ID NO: 200979 - protein, 9 aa, Homo Sapiens
ALCVESVDK

SEQ ID NO: 200980 - protein, 9 aa, Homo Sapiens
EVIPMAAVK

SEQ ID NO: 200981 - protein, 9 aa, Homo Sapiens
FLSYKLSQK

SEQ ID NO: 200982 - protein, 9 aa, Homo Sapiens
RYRRAFSDL

SEQ ID NO: 200983 - protein, 9 aa, Homo Sapiens
NWGRIVAFF

SEQ ID NO: 200984 - protein, 9 aa, Homo Sapiens
GRIVAFFSF

SEQ ID NO: 200985 - protein, 9 aa, Homo Sapiens
NWGRIVAFF

SEQ ID NO: 200986 - protein, 9 aa, Homo Sapiens
RYRRAFSDL

SEQ ID NO: 200987 - protein, 9 aa, Homo Sapiens
RYRRAFSDL

SEQ ID NO: 200988 - protein, 9 aa, Homo Sapiens
SFEQVVNEL

SEQ ID NO: 200989 - protein, 9 aa, Homo Sapiens
AYQSFEQVV

SEQ ID NO: 200990 - protein, 9 aa, Homo Sapiens
ELVVDFLSY

SEQ ID NO: 200991 - protein, 9 aa, Homo Sapiens
RIAAWMATY

SEQ ID NO: 200992 - protein, 9 aa, Homo Sapiens
RIAAWMATY

SEQ ID NO: 200993 - protein, 9 aa, Homo Sapiens
ELVVDFLSY

SEQ ID NO: 200994 - protein, 9 aa, Homo Sapiens
LVSRIAAWM

SEQ ID NO: 200995 - protein, 9 aa, Homo Sapiens
SVDKEMQVL

SEQ ID NO: 200996 - protein, 9 aa, Homo Sapiens
EVIPMAAVK

SEQ ID NO: 200997 - protein, 9 aa, Homo Sapiens
MTVAGVVLL

SEQ ID NO: 200998 - protein, 9 aa, Homo Sapiens
LHITPGTAY

SEQ ID NO: 200999 - protein, 9 aa, Homo Sapiens
ELVVDFLSY

SEQ ID NO: 201000 - protein, 9 aa, Homo Sapiens
RIAAWMATY

SEQ ID NO: 201001 - protein, 9 aa, Homo Sapiens
MAAVKQALR

SEQ ID NO: 201002 - protein, 9 aa, Homo Sapiens
VLLGSLFSR

SEQ ID NO: 201003 - protein, 9 aa, Homo Sapiens
LVVDFLSYK

SEQ ID NO: 201004 - protein, 9 aa, Homo Sapiens
KEMQVLVSR

SEQ ID NO: 201005 - protein, 9 aa, Homo Sapiens
DEFELRYRR

SEQ ID NO: 201006 - protein, 9 aa, Homo Sapiens
MAAVKQALR

SEQ ID NO: 201007 - protein, 9 aa, Homo Sapiens
ELRYRRAFS

SEQ ID NO: 201008 - protein, 9 aa, Homo Sapiens
VLLGSLFSR

SEQ ID NO: 201009 - protein, 9 aa, Homo Sapiens
EAGDEFELR

SEQ ID NO: 201010 - protein, 9 aa, Homo Sapiens
QFSDVEENR

SEQ ID NO: 201011 - protein, 9 aa, Homo Sapiens
EVIPMAAVK

SEQ ID NO: 201012 - protein, 9 aa, Homo Sapiens
MAAVKQALR

SEQ ID NO: 201013 - protein, 9 aa, Homo Sapiens
LVVDFLSYK

SEQ ID NO: 201014 - protein, 9 aa, Homo Sapiens
EAGDEFELR

SEQ ID NO: 201015 - protein, 9 aa, Homo Sapiens
EQVVNELFR

SEQ ID NO: 201016 - protein, 9 aa, Homo Sapiens
FLSYKLSQK

SEQ ID NO: 201017 - protein, 9 aa, Homo Sapiens
DEFELRYRR

SEQ ID NO: 201018 - protein, 9 aa, Homo Sapiens
QFSDVEENR

SEQ ID NO: 201019 - protein, 9 aa, Homo Sapiens
NNAAAESRK

SEQ ID NO: 201020 - protein, 9 aa, Homo Sapiens
VLLGSLFSR

SEQ ID NO: 201021 - protein, 9 aa, Homo Sapiens
MTVAGVVLL

SEQ ID NO: 201022 - protein, 9 aa, Homo Sapiens
TAYQSFEQV

SEQ ID NO: 201023 - protein, 9 aa, Homo Sapiens
TGMTVAGVV

SEQ ID NO: 201024 - protein, 9 aa, Homo Sapiens
MSQSNRELV

SEQ ID NO: 201025 - protein, 9 aa, Homo Sapiens
YSWSQFSDV

SEQ ID NO: 201026 - protein, 9 aa, Homo Sapiens
FSFGGALCV

SEQ ID NO: 201027 - protein, 9 aa, Homo Sapiens
ESVDKEMQV

SEQ ID NO: 201028 - protein, 9 aa, Homo Sapiens
MATYLNDHL

SEQ ID NO: 201029 - protein, 9 aa, Homo Sapiens
ELYGNNAAA

SEQ ID NO: 201030 - protein, 9 aa, Homo Sapiens
VAFFSFGGA

SEQ ID NO: 201031 - protein, 9 aa, Homo Sapiens
LTGMTVAGV

SEQ ID NO: 201032 - protein, 9 aa, Homo Sapiens
IAAWMATYL

SEQ ID NO: 201033 - protein, 9 aa, Homo Sapiens
MTVAGVVLL

SEQ ID NO: 201034 - protein, 9 aa, Homo Sapiens
TAYQSFEQV

SEQ ID NO: 201035 - protein, 9 aa, Homo Sapiens
ELYGNNAAA

SEQ ID NO: 201036 - protein, 9 aa, Homo Sapiens
FSFGGALCV

SEQ ID NO: 201037 - protein, 9 aa, Homo Sapiens
LTGMTVAGV

SEQ ID NO: 201038 - protein, 9 aa, Homo Sapiens
YSWSQFSDV

SEQ ID NO: 201039 - protein, 9 aa, Homo Sapiens
APEGTESEM

SEQ ID NO: 201040 - protein, 9 aa, Homo Sapiens
SPAVNGATG

SEQ ID NO: 201041 - protein, 9 aa, Homo Sapiens
TPGTAYQSF

SEQ ID NO: 201042 - protein, 9 aa, Homo Sapiens
FELRYRRAF

SEQ ID NO: 201043 - protein, 9 aa, Homo Sapiens
RIAAWMATY

SEQ ID NO: 201044 - protein, 9 aa, Homo Sapiens
ALREAGDEF

SEQ ID NO: 201045 - protein, 9 aa, Homo Sapiens
FELRYRRAF

SEQ ID NO: 201046 - protein, 9 aa, Homo Sapiens
QERFNRWFL

SEQ ID NO: 201047 - protein, 9 aa, Homo Sapiens
FEQVVNELF

SEQ ID NO: 201048 - protein, 9 aa, Homo Sapiens
QENGGWDTF

SEQ ID NO: 201049 - protein, 9 aa, Homo Sapiens
GRIVAFFSF

SEQ ID NO: 201050 - protein, 9 aa, Homo Sapiens
RRAFSDLTS

SEQ ID NO: 201051 - protein, 9 aa, Homo Sapiens
TPGTAYQSF

SEQ ID NO: 201052 - protein, 9 aa, Homo Sapiens
IAAWMATYL

SEQ ID NO: 201053 - protein, 9 aa, Homo Sapiens
APEGTESEM

SEQ ID NO: 201054 - protein, 9 aa, Homo Sapiens
ELVVDFLSY

SEQ ID NO: 201055 - protein, 9 aa, Homo Sapiens
LHITPGTAY

SEQ ID NO: 201056 - protein, 9 aa, Homo Sapiens
NPSWHLADS

SEQ ID NO: 201057 - protein, 9 aa, Homo Sapiens
RIAAWMATY

SEQ ID NO: 201058 - protein, 9 aa, Homo Sapiens
REAGDEFEL

SEQ ID NO: 201059 - protein, 9 aa, Homo Sapiens
QERFNRWFL

SEQ ID NO: 201060 - protein, 9 aa, Homo Sapiens
QENGGWDTF

SEQ ID NO: 201061 - protein, 9 aa, Homo Sapiens
FEQVVNELF

SEQ ID NO: 201062 - protein, 9 aa, Homo Sapiens
FELRYRRAF

SEQ ID NO: 201063 - protein, 9 aa, Homo Sapiens
SEMETPSAI

SEQ ID NO: 201064 - protein, 9 aa, Homo Sapiens
FELRYRRAF

SEQ ID NO: 201065 - protein, 9 aa, Homo Sapiens
QENGGWDTF

SEQ ID NO: 201066 - protein, 9 aa, Homo Sapiens
SEMETPSAI

SEQ ID NO: 201067 - protein, 9 aa, Homo Sapiens
RELVVDFLS

SEQ ID NO: 201068 - protein, 9 aa, Homo Sapiens
REVIPMAAV

SEQ ID NO: 201069 - protein, 9 aa, Homo Sapiens
IAAWMATYL

SEQ ID NO: 201070 - protein, 9 aa, Homo Sapiens
IPMAAVKQA

SEQ ID NO: 201071 - protein, 9 aa, Homo Sapiens
SAINGNPSW

SEQ ID NO: 201072 - protein, 9 aa, Homo Sapiens
KLSQKGYSW

SEQ ID NO: 201073 - protein, 9 aa, Homo Sapiens
IAAWMATYL

SEQ ID NO: 201074 - protein, 9 aa, Homo Sapiens
YLNDHLEPW

SEQ ID NO: 201075 - protein, 10 aa, Homo Sapiens
FSDLTSQLHI

SEQ ID NO: 201076 - protein, 10 aa, Homo Sapiens
YLNDHLEPWI

SEQ ID NO: 201077 - protein, 10 aa, Homo Sapiens
FLTGMTVAGV

SEQ ID NO: 201078 - protein, 10 aa, Homo Sapiens
RIAAWMATYL

SEQ ID NO: 201079 - protein, 10 aa, Homo Sapiens
WMATYLNDHL

SEQ ID NO: 201080 - protein, 10 aa, Homo Sapiens
LVVDFLSYKL

SEQ ID NO: 201081 - protein, 10 aa, Homo Sapiens
SLDAREVIPM

SEQ ID NO: 201082 - protein, 10 aa, Homo Sapiens
VLVSRIAAWM

SEQ ID NO: 201083 - protein, 10 aa, Homo Sapiens
SVDKEMQVLV

SEQ ID NO: 201084 - protein, 10 aa, Homo Sapiens
GMTVAGVVLL

SEQ ID NO: 201085 - protein, 10 aa, Homo Sapiens
FLTGMTVAGV

SEQ ID NO: 201086 - protein, 10 aa, Homo Sapiens
WMATYLNDHL

SEQ ID NO: 201087 - protein, 10 aa, Homo Sapiens
RIAAWMATYL

SEQ ID NO: 201088 - protein, 10 aa, Homo Sapiens
LVVDFLSYKL

SEQ ID NO: 201089 - protein, 10 aa, Homo Sapiens
RAFSDLTSQL

SEQ ID NO: 201090 - protein, 10 aa, Homo Sapiens
SLDAREVIPM

SEQ ID NO: 201091 - protein, 10 aa, Homo Sapiens
YLNDHLEPWI

SEQ ID NO: 201092 - protein, 10 aa, Homo Sapiens
GMTVAGVVLL

SEQ ID NO: 201093 - protein, 10 aa, Homo Sapiens
FGGALCVESV

SEQ ID NO: 201094 - protein, 10 aa, Homo Sapiens
VLVSRIAAWM

SEQ ID NO: 201095 - protein, 10 aa, Homo Sapiens
FLTGMTVAGV

SEQ ID NO: 201096 - protein, 10 aa, Homo Sapiens
YLNDHLEPWI

SEQ ID NO: 201097 - protein, 10 aa, Homo Sapiens
RIAAWMATYL

SEQ ID NO: 201098 - protein, 10 aa, Homo Sapiens
WMATYLNDHL

SEQ ID NO: 201099 - protein, 10 aa, Homo Sapiens
VLVSRIAAWM

SEQ ID NO: 201100 - protein, 10 aa, Homo Sapiens
IVAFFSFGGA

SEQ ID NO: 201101 - protein, 10 aa, Homo Sapiens
LVVDFLSYKL

SEQ ID NO: 201102 - protein, 10 aa, Homo Sapiens
VVNELFRDGV

SEQ ID NO: 201103 - protein, 10 aa, Homo Sapiens
GMTVAGVVLL

SEQ ID NO: 201104 - protein, 10 aa, Homo Sapiens
RAFSDLTSQL

SEQ ID NO: 201105 - protein, 10 aa, Homo Sapiens
LTGMTVAGVV

SEQ ID NO: 201106 - protein, 10 aa, Homo Sapiens
GTAYQSFEQV

SEQ ID NO: 201107 - protein, 10 aa, Homo Sapiens
FLTGMTVAGV

SEQ ID NO: 201108 - protein, 10 aa, Homo Sapiens
YLNDHLEPWI

SEQ ID NO: 201109 - protein, 10 aa, Homo Sapiens
SLDAREVIPM

SEQ ID NO: 201110 - protein, 10 aa, Homo Sapiens
RIAAWMATYL

SEQ ID NO: 201111 - protein, 10 aa, Homo Sapiens
LVVDFLSYKL

SEQ ID NO: 201112 - protein, 10 aa, Homo Sapiens
AINGNPSWHL

SEQ ID NO: 201113 - protein, 10 aa, Homo Sapiens
FLTGMTVAGV

SEQ ID NO: 201114 - protein, 10 aa, Homo Sapiens
RIAAWMATYL

SEQ ID NO: 201115 - protein, 10 aa, Homo Sapiens
YLNDHLEPWI

SEQ ID NO: 201116 - protein, 10 aa, Homo Sapiens
MQVLVSRIAA

SEQ ID NO: 201117 - protein, 10 aa, Homo Sapiens
LVVDFLSYKL

SEQ ID NO: 201118 - protein, 10 aa, Homo Sapiens
WMATYLNDHL

SEQ ID NO: 201119 - protein, 10 aa, Homo Sapiens
SQLHITPGTA

SEQ ID NO: 201120 - protein, 10 aa, Homo Sapiens
GTAYQSFEQV

SEQ ID NO: 201121 - protein, 10 aa, Homo Sapiens
SVDKEMQVLV

SEQ ID NO: 201122 - protein, 10 aa, Homo Sapiens
RAFSDLTSQL

SEQ ID NO: 201123 - protein, 10 aa, Homo Sapiens
KEMQVLVSRI

SEQ ID NO: 201124 - protein, 10 aa, Homo Sapiens
IQENGGWDTF

SEQ ID NO: 201125 - protein, 10 aa, Homo Sapiens
IVAFFSFGGA

SEQ ID NO: 201126 - protein, 10 aa, Homo Sapiens
VVNELFRDGV

SEQ ID NO: 201127 - protein, 10 aa, Homo Sapiens
TAYQSFEQVV

SEQ ID NO: 201128 - protein, 10 aa, Homo Sapiens
FLTGMTVAGV

SEQ ID NO: 201129 - protein, 10 aa, Homo Sapiens
YLNDHLEPWI

SEQ ID NO: 201130 - protein, 10 aa, Homo Sapiens
SVDKEMQVLV

SEQ ID NO: 201131 - protein, 10 aa, Homo Sapiens
SLDAREVIPM

SEQ ID NO: 201132 - protein, 10 aa, Homo Sapiens
GMTVAGVVLL

SEQ ID NO: 201133 - protein, 10 aa, Homo Sapiens
LVVDFLSYKL

SEQ ID NO: 201134 - protein, 10 aa, Homo Sapiens
RIAAWMATYL

SEQ ID NO: 201135 - protein, 10 aa, Homo Sapiens
VVNELFRDGV

SEQ ID NO: 201136 - protein, 10 aa, Homo Sapiens
AINGNPSWHL

SEQ ID NO: 201137 - protein, 10 aa, Homo Sapiens
WMATYLNDHL

SEQ ID NO: 201138 - protein, 10 aa, Homo Sapiens
TAYQSFEQVV

SEQ ID NO: 201139 - protein, 10 aa, Homo Sapiens
VLVSRIAAWM

SEQ ID NO: 201140 - protein, 10 aa, Homo Sapiens
FFSFGGALCV

SEQ ID NO: 201141 - protein, 10 aa, Homo Sapiens
VLLGSLFSRK

SEQ ID NO: 201142 - protein, 10 aa, Homo Sapiens
RAFSDLTSQL

SEQ ID NO: 201143 - protein, 10 aa, Homo Sapiens
GTAYQSFEQV

SEQ ID NO: 201144 - protein, 10 aa, Homo Sapiens
FLTGMTVAGV

SEQ ID NO: 201145 - protein, 10 aa, Homo Sapiens
YLNDHLEPWI

SEQ ID NO: 201146 - protein, 10 aa, Homo Sapiens
SVDKEMQVLV

SEQ ID NO: 201147 - protein, 10 aa, Homo Sapiens
WMATYLNDHL

SEQ ID NO: 201148 - protein, 10 aa, Homo Sapiens
VVNELFRDGV

SEQ ID NO: 201149 - protein, 10 aa, Homo Sapiens
LVVDFLSYKL

SEQ ID NO: 201150 - protein, 10 aa, Homo Sapiens
VLVSRIAAWM

SEQ ID NO: 201151 - protein, 10 aa, Homo Sapiens
SLDAREVIPM

SEQ ID NO: 201152 - protein, 10 aa, Homo Sapiens
AINGNPSWHL

SEQ ID NO: 201153 - protein, 10 aa, Homo Sapiens
RIAAWMATYL

SEQ ID NO: 201154 - protein, 10 aa, Homo Sapiens
FFSFGGALCV

SEQ ID NO: 201155 - protein, 10 aa, Homo Sapiens
VLLGSLFSRK

SEQ ID NO: 201156 - protein, 10 aa, Homo Sapiens
TAYQSFEQVV

SEQ ID NO: 201157 - protein, 10 aa, Homo Sapiens
ELYGNNAAAE

SEQ ID NO: 201158 - protein, 10 aa, Homo Sapiens
GMTVAGVVLL

SEQ ID NO: 201159 - protein, 10 aa, Homo Sapiens
FLTGMTVAGV

SEQ ID NO: 201160 - protein, 10 aa, Homo Sapiens
YLNDHLEPWI

SEQ ID NO: 201161 - protein, 10 aa, Homo Sapiens
SVDKEMQVLV

SEQ ID NO: 201162 - protein, 10 aa, Homo Sapiens
WMATYLNDHL

SEQ ID NO: 201163 - protein, 10 aa, Homo Sapiens
RIAAWMATYL

SEQ ID NO: 201164 - protein, 10 aa, Homo Sapiens
AINGNPSWHL

SEQ ID NO: 201165 - protein, 10 aa, Homo Sapiens
VLVSRIAAWM

SEQ ID NO: 201166 - protein, 10 aa, Homo Sapiens
LVVDFLSYKL

SEQ ID NO: 201167 - protein, 10 aa, Homo Sapiens
SLDAREVIPM

SEQ ID NO: 201168 - protein, 10 aa, Homo Sapiens
GMTVAGVVLL

SEQ ID NO: 201169 - protein, 10 aa, Homo Sapiens
TAYQSFEQVV

SEQ ID NO: 201170 - protein, 10 aa, Homo Sapiens
FFSFGGALCV

SEQ ID NO: 201171 - protein, 10 aa, Homo Sapiens
GTAYQSFEQV

SEQ ID NO: 201172 - protein, 10 aa, Homo Sapiens
FLTGMTVAGV

SEQ ID NO: 201173 - protein, 10 aa, Homo Sapiens
YLNDHLEPWI

SEQ ID NO: 201174 - protein, 10 aa, Homo Sapiens
WMATYLNDHL

SEQ ID NO: 201175 - protein, 10 aa, Homo Sapiens
AINGNPSWHL

SEQ ID NO: 201176 - protein, 10 aa, Homo Sapiens
LVVDFLSYKL

SEQ ID NO: 201177 - protein, 10 aa, Homo Sapiens
SVDKEMQVLV

SEQ ID NO: 201178 - protein, 10 aa, Homo Sapiens
RIAAWMATYL

SEQ ID NO: 201179 - protein, 10 aa, Homo Sapiens
SLDAREVIPM

SEQ ID NO: 201180 - protein, 10 aa, Homo Sapiens
VLVSRIAAWM

SEQ ID NO: 201181 - protein, 10 aa, Homo Sapiens
VLLGSLFSRK

SEQ ID NO: 201182 - protein, 10 aa, Homo Sapiens
ELVVDFLSYK

SEQ ID NO: 201183 - protein, 10 aa, Homo Sapiens
GALCVESVDK

SEQ ID NO: 201184 - protein, 10 aa, Homo Sapiens
VVLLGSLFSR

SEQ ID NO: 201185 - protein, 10 aa, Homo Sapiens
REVIPMAAVK

SEQ ID NO: 201186 - protein, 10 aa, Homo Sapiens
VLLGSLFSRK

SEQ ID NO: 201187 - protein, 10 aa, Homo Sapiens
VVLLGSLFSR

SEQ ID NO: 201188 - protein, 10 aa, Homo Sapiens
GALCVESVDK

SEQ ID NO: 201189 - protein, 10 aa, Homo Sapiens
SQFSDVEENR

SEQ ID NO: 201190 - protein, 10 aa, Homo Sapiens
SFEQVVNELF

SEQ ID NO: 201191 - protein, 10 aa, Homo Sapiens
TYLNDHLEPW

SEQ ID NO: 201192 - protein, 10 aa, Homo Sapiens
SFEQVVNELF

SEQ ID NO: 201193 - protein, 10 aa, Homo Sapiens
TYLNDHLEPW

SEQ ID NO: 201194 - protein, 10 aa, Homo Sapiens
ITPGTAYQSF

SEQ ID NO: 201195 - protein, 10 aa, Homo Sapiens
TYLNDHLEPW

SEQ ID NO: 201196 - protein, 10 aa, Homo Sapiens
SFEQVVNELF

SEQ ID NO: 201197 - protein, 10 aa, Homo Sapiens
ITPGTAYQSF

SEQ ID NO: 201198 - protein, 10 aa, Homo Sapiens
EAPEGTESEM

SEQ ID NO: 201199 - protein, 10 aa, Homo Sapiens
RIAAWMATYL

SEQ ID NO: 201200 - protein, 10 aa, Homo Sapiens
ITPGTAYQSF

SEQ ID NO: 201201 - protein, 10 aa, Homo Sapiens
VLVSRIAAWM

SEQ ID NO: 201202 - protein, 10 aa, Homo Sapiens
EAPEGTESEM

SEQ ID NO: 201203 - protein, 10 aa, Homo Sapiens
ESVDKEMQVL

SEQ ID NO: 201204 - protein, 10 aa, Homo Sapiens
EFELRYRRAF

SEQ ID NO: 201205 - protein, 10 aa, Homo Sapiens
QLHITPGTAY

SEQ ID NO: 201206 - protein, 10 aa, Homo Sapiens
VVLLGSLFSR

SEQ ID NO: 201207 - protein, 10 aa, Homo Sapiens
LFRDGVNWGR

SEQ ID NO: 201208 - protein, 10 aa, Homo Sapiens
SRKGQERFNR

SEQ ID NO: 201209 - protein, 10 aa, Homo Sapiens
PMAAVKQALR

SEQ ID NO: 201210 - protein, 10 aa, Homo Sapiens
VVLLGSLFSR

SEQ ID NO: 201211 - protein, 10 aa, Homo Sapiens
LFRDGVNWGR

SEQ ID NO: 201212 - protein, 10 aa, Homo Sapiens
DFLSYKLSQK

SEQ ID NO: 201213 - protein, 10 aa, Homo Sapiens
ELVVDFLSYK

SEQ ID NO: 201214 - protein, 10 aa, Homo Sapiens
SQFSDVEENR

SEQ ID NO: 201215 - protein, 10 aa, Homo Sapiens
VVLLGSLFSR

SEQ ID NO: 201216 - protein, 10 aa, Homo Sapiens
YGNNAAAESR

SEQ ID NO: 201217 - protein, 10 aa, Homo Sapiens
EVIPMAAVKQ

SEQ ID NO: 201218 - protein, 10 aa, Homo Sapiens
MATYLNDHLE

SEQ ID NO: 201219 - protein, 10 aa, Homo Sapiens
IVAFFSFGGA

SEQ ID NO: 201220 - protein, 10 aa, Homo Sapiens
GTAYQSFEQV

SEQ ID NO: 201221 - protein, 10 aa, Homo Sapiens
LVVDFLSYKL

SEQ ID NO: 201222 - protein, 10 aa, Homo Sapiens
QSFEQVVNEL

SEQ ID NO: 201223 - protein, 10 aa, Homo Sapiens
FLTGMTVAGV

SEQ ID NO: 201224 - protein, 10 aa, Homo Sapiens
TAYQSFEQVV

SEQ ID NO: 201225 - protein, 10 aa, Homo Sapiens
RIAAWMATYL

SEQ ID NO: 201226 - protein, 10 aa, Homo Sapiens
NGATGHSSSL

SEQ ID NO: 201227 - protein, 10 aa, Homo Sapiens
TVAGVVLLGS

SEQ ID NO: 201228 - protein, 10 aa, Homo Sapiens
FGGALCVESV

SEQ ID NO: 201229 - protein, 10 aa, Homo Sapiens
VVNELFRDGV

SEQ ID NO: 201230 - protein, 10 aa, Homo Sapiens
LVSRIAAWMA

SEQ ID NO: 201231 - protein, 10 aa, Homo Sapiens
TGMTVAGVVL

SEQ ID NO: 201232 - protein, 10 aa, Homo Sapiens
SVDKEMQVLV

SEQ ID NO: 201233 - protein, 10 aa, Homo Sapiens
FLTGMTVAGV

SEQ ID NO: 201234 - protein, 10 aa, Homo Sapiens
TAYQSFEQVV

SEQ ID NO: 201235 - protein, 10 aa, Homo Sapiens
LVVDFLSYKL

SEQ ID NO: 201236 - protein, 10 aa, Homo Sapiens
RIAAWMATYL

SEQ ID NO: 201237 - protein, 10 aa, Homo Sapiens
GTAYQSFEQV

SEQ ID NO: 201238 - protein, 10 aa, Homo Sapiens
IPMAAVKQAL

SEQ ID NO: 201239 - protein, 10 aa, Homo Sapiens
SQKGYSWSQF

SEQ ID NO: 201240 - protein, 10 aa, Homo Sapiens
QLHITPGTAY

SEQ ID NO: 201241 - protein, 10 aa, Homo Sapiens
GVNWGRIVAF

SEQ ID NO: 201242 - protein, 10 aa, Homo Sapiens
IQENGGWDTF

SEQ ID NO: 201243 - protein, 10 aa, Homo Sapiens
LSYKLSQKGY

SEQ ID NO: 201244 - protein, 10 aa, Homo Sapiens
RELVVDFLSY

SEQ ID NO: 201245 - protein, 10 aa, Homo Sapiens
SRIAAWMATY

SEQ ID NO: 201246 - protein, 10 aa, Homo Sapiens
RRAFSDLTSQ

SEQ ID NO: 201247 - protein, 10 aa, Homo Sapiens
IPMAAVKQAL

SEQ ID NO: 201248 - protein, 10 aa, Homo Sapiens
EPWIQENGGW

SEQ ID NO: 201249 - protein, 10 aa, Homo Sapiens
EAGDEFELRY

SEQ ID NO: 201250 - protein, 10 aa, Homo Sapiens
EAPEGTESEM

SEQ ID NO: 201251 - protein, 10 aa, Homo Sapiens
QALREAGDEF

SEQ ID NO: 201252 - protein, 10 aa, Homo Sapiens
SPAVNGATGH

SEQ ID NO: 201253 - protein, 10 aa, Homo Sapiens
TPSAINGNPS

SEQ ID NO: 201254 - protein, 10 aa, Homo Sapiens
GVNWGRIVAF

SEQ ID NO: 201255 - protein, 10 aa, Homo Sapiens
VAFFSFGGAL

SEQ ID NO: 201256 - protein, 10 aa, Homo Sapiens
FVELYGNNAA

SEQ ID NO: 201257 - protein, 10 aa, Homo Sapiens
AESRKGQERF

SEQ ID NO: 201258 - protein, 10 aa, Homo Sapiens
EPWIQENGGW

SEQ ID NO: 201259 - protein, 10 aa, Homo Sapiens
QSNRELVVDF

SEQ ID NO: 201260 - protein, 10 aa, Homo Sapiens
QVLVSRIAAW

SEQ ID NO: 201261 - protein, 10 aa, Homo Sapiens
PSAINGNPSW

SEQ ID NO: 201262 - protein, 11 aa, Homo Sapiens
FLTGMTVAGVV

SEQ ID NO: 201263 - protein, 11 aa, Homo Sapiens
SLDAREVIPMA

SEQ ID NO: 201264 - protein, 11 aa, Homo Sapiens
VLVSRIAAWMA

SEQ ID NO: 201265 - protein, 11 aa, Homo Sapiens
HLADSPAVNGA

SEQ ID NO: 201266 - protein, 11 aa, Homo Sapiens
YLNDHLEPWIQ

SEQ ID NO: 201267 - protein, 11 aa, Homo Sapiens
ALREAGDEFEL

SEQ ID NO: 201268 - protein, 11 aa, Homo Sapiens
YQSFEQVVNEL

SEQ ID NO: 201269 - protein, 11 aa, Homo Sapiens
HLADSPAVNGA

SEQ ID NO: 201270 - protein, 11 aa, Homo Sapiens
FLTGMTVAGVV

SEQ ID NO: 201271 - protein, 11 aa, Homo Sapiens
YQSFEQVVNEL

SEQ ID NO: 201272 - protein, 11 aa, Homo Sapiens
ALREAGDEFEL

SEQ ID NO: 201273 - protein, 11 aa, Homo Sapiens
YLNDHLEPWIQ

SEQ ID NO: 201274 - protein, 11 aa, Homo Sapiens
IVAFFSFGGAL

SEQ ID NO: 201275 - protein, 11 aa, Homo Sapiens
TVAGVVLLGSL

SEQ ID NO: 201276 - protein, 11 aa, Homo Sapiens
VLVSRIAAWMA

SEQ ID NO: 201277 - protein, 11 aa, Homo Sapiens
KLSQKGYSWSQ

SEQ ID NO: 201278 - protein, 11 aa, Homo Sapiens
ELVVDFLSYKL

SEQ ID NO: 201279 - protein, 11 aa, Homo Sapiens
SLDAREVIPMA

SEQ ID NO: 201280 - protein, 11 aa, Homo Sapiens
FLTGMTVAGVV

SEQ ID NO: 201281 - protein, 11 aa, Homo Sapiens
HLADSPAVNGA

SEQ ID NO: 201282 - protein, 11 aa, Homo Sapiens
RIVAFFSFGGA

SEQ ID NO: 201283 - protein, 11 aa, Homo Sapiens
VLVSRIAAWMA

SEQ ID NO: 201284 - protein, 11 aa, Homo Sapiens
TVAGVVLLGSL

SEQ ID NO: 201285 - protein, 11 aa, Homo Sapiens
ALREAGDEFEL

SEQ ID NO: 201286 - protein, 11 aa, Homo Sapiens
YQSFEQVVNEL

SEQ ID NO: 201287 - protein, 11 aa, Homo Sapiens
YLNDHLEPWIQ

SEQ ID NO: 201288 - protein, 11 aa, Homo Sapiens
AINGNPSWHLA

SEQ ID NO: 201289 - protein, 11 aa, Homo Sapiens
FNRWFLTGMTV

SEQ ID NO: 201290 - protein, 11 aa, Homo Sapiens
IVAFFSFGGAL

SEQ ID NO: 201291 - protein, 11 aa, Homo Sapiens
SLDAREVIPMA

SEQ ID NO: 201292 - protein, 11 aa, Homo Sapiens
MAAVKQALREA

SEQ ID NO: 201293 - protein, 11 aa, Homo Sapiens
QVVNELFRDGV

SEQ ID NO: 201294 - protein, 11 aa, Homo Sapiens
FLTGMTVAGVV

SEQ ID NO: 201295 - protein, 11 aa, Homo Sapiens
ALREAGDEFEL

SEQ ID NO: 201296 - protein, 11 aa, Homo Sapiens
VLVSRIAAWMA

SEQ ID NO: 201297 - protein, 11 aa, Homo Sapiens
YLNDHLEPWIQ

SEQ ID NO: 201298 - protein, 11 aa, Homo Sapiens
SLDAREVIPMA

SEQ ID NO: 201299 - protein, 11 aa, Homo Sapiens
FLTGMTVAGVV

SEQ ID NO: 201300 - protein, 11 aa, Homo Sapiens
RIVAFFSFGGA

SEQ ID NO: 201301 - protein, 11 aa, Homo Sapiens
IQENGGWDTFV

SEQ ID NO: 201302 - protein, 11 aa, Homo Sapiens
YQSFEQVVNEL

SEQ ID NO: 201303 - protein, 11 aa, Homo Sapiens
SAINGNPSWHL

SEQ ID NO: 201304 - protein, 11 aa, Homo Sapiens
QVVNELFRDGV

SEQ ID NO: 201305 - protein, 11 aa, Homo Sapiens
VLVSRIAAWMA

SEQ ID NO: 201306 - protein, 11 aa, Homo Sapiens
KQALREAGDEF

SEQ ID NO: 201307 - protein, 11 aa, Homo Sapiens
HLADSPAVNGA

SEQ ID NO: 201308 - protein, 11 aa, Homo Sapiens
TVAGVVLLGSL

SEQ ID NO: 201309 - protein, 11 aa, Homo Sapiens
ALREAGDEFEL

SEQ ID NO: 201310 - protein, 11 aa, Homo Sapiens
SQLHITPGTAY

SEQ ID NO: 201311 - protein, 11 aa, Homo Sapiens
FLTGMTVAGVV

SEQ ID NO: 201312 - protein, 11 aa, Homo Sapiens
SLDAREVIPMA

SEQ ID NO: 201313 - protein, 11 aa, Homo Sapiens
YLNDHLEPWIQ

SEQ ID NO: 201314 - protein, 11 aa, Homo Sapiens
ALREAGDEFEL

SEQ ID NO: 201315 - protein, 11 aa, Homo Sapiens
HLADSPAVNGA

SEQ ID NO: 201316 - protein, 11 aa, Homo Sapiens
VLVSRIAAWMA

SEQ ID NO: 201317 - protein, 11 aa, Homo Sapiens
KLSQKGYSWSQ

SEQ ID NO: 201318 - protein, 11 aa, Homo Sapiens
ELVVDFLSYKL

SEQ ID NO: 201319 - protein, 11 aa, Homo Sapiens
TVAGVVLLGSL

SEQ ID NO: 201320 - protein, 11 aa, Homo Sapiens
AINGNPSWHLA

SEQ ID NO: 201321 - protein, 11 aa, Homo Sapiens
WFLTGMTVAGV

SEQ ID NO: 201322 - protein, 11 aa, Homo Sapiens
AFFSFGGALCV

SEQ ID NO: 201323 - protein, 11 aa, Homo Sapiens
SFGGALCVESV

SEQ ID NO: 201324 - protein, 11 aa, Homo Sapiens
VIPMAAVKQAL

SEQ ID NO: 201325 - protein, 11 aa, Homo Sapiens
QVVNELFRDGV

SEQ ID NO: 201326 - protein, 11 aa, Homo Sapiens
FRDGVNWGRIV

SEQ ID NO: 201327 - protein, 11 aa, Homo Sapiens
SAINGNPSWHL

SEQ ID NO: 201328 - protein, 11 aa, Homo Sapiens
ELYGNNAAAES

SEQ ID NO: 201329 - protein, 11 aa, Homo Sapiens
CVESVDKEMQV

SEQ ID NO: 201330 - protein, 11 aa, Homo Sapiens
GTAYQSFEQVV

SEQ ID NO: 201331 - protein, 11 aa, Homo Sapiens
IVAFFSFGGAL

SEQ ID NO: 201332 - protein, 11 aa, Homo Sapiens
FLTGMTVAGVV

SEQ ID NO: 201333 - protein, 11 aa, Homo Sapiens
YLNDHLEPWIQ

SEQ ID NO: 201334 - protein, 11 aa, Homo Sapiens
ALREAGDEFEL

SEQ ID NO: 201335 - protein, 11 aa, Homo Sapiens
SLDAREVIPMA

SEQ ID NO: 201336 - protein, 11 aa, Homo Sapiens
HLADSPAVNGA

SEQ ID NO: 201337 - protein, 11 aa, Homo Sapiens
VLVSRIAAWMA

SEQ ID NO: 201338 - protein, 11 aa, Homo Sapiens
VIPMAAVKQAL

SEQ ID NO: 201339 - protein, 11 aa, Homo Sapiens
KLSQKGYSWSQ

SEQ ID NO: 201340 - protein, 11 aa, Homo Sapiens
WFLTGMTVAGV

SEQ ID NO: 201341 - protein, 11 aa, Homo Sapiens
ELVVDFLSYKL

SEQ ID NO: 201342 - protein, 11 aa, Homo Sapiens
FRDGVNWGRIV

SEQ ID NO: 201343 - protein, 11 aa, Homo Sapiens
FLTGMTVAGVV

SEQ ID NO: 201344 - protein, 11 aa, Homo Sapiens
ALREAGDEFEL

SEQ ID NO: 201345 - protein, 11 aa, Homo Sapiens
SLDAREVIPMA

SEQ ID NO: 201346 - protein, 11 aa, Homo Sapiens
VLVSRIAAWMA

SEQ ID NO: 201347 - protein, 11 aa, Homo Sapiens
CVESVDKEMQV

SEQ ID NO: 201348 - protein, 11 aa, Homo Sapiens
HLADSPAVNGA

SEQ ID NO: 201349 - protein, 11 aa, Homo Sapiens
SFGGALCVESV

SEQ ID NO: 201350 - protein, 11 aa, Homo Sapiens
YLNDHLEPWIQ

SEQ ID NO: 201351 - protein, 11 aa, Homo Sapiens
KLSQKGYSWSQ

SEQ ID NO: 201352 - protein, 11 aa, Homo Sapiens
ELVVDFLSYKL

SEQ ID NO: 201353 - protein, 11 aa, Homo Sapiens
TVAGVVLLGSL

SEQ ID NO: 201354 - protein, 11 aa, Homo Sapiens
AFFSFGGALCV

SEQ ID NO: 201355 - protein, 11 aa, Homo Sapiens
IQENGGWDTFV

SEQ ID NO: 201356 - protein, 11 aa, Homo Sapiens
QVVNELFRDGV

SEQ ID NO: 201357 - protein, 11 aa, Homo Sapiens
VIPMAAVKQAL

SEQ ID NO: 201358 - protein, 11 aa, Homo Sapiens
ELYGNNAAAES

SEQ ID NO: 201359 - protein, 11 aa, Homo Sapiens
SAINGNPSWHL

SEQ ID NO: 201360 - protein, 11 aa, Homo Sapiens
WFLTGMTVAGV

SEQ ID NO: 201361 - protein, 11 aa, Homo Sapiens
AINGNPSWHLA

SEQ ID NO: 201362 - protein, 11 aa, Homo Sapiens
FLTGMTVAGVV

SEQ ID NO: 201363 - protein, 11 aa, Homo Sapiens
HLADSPAVNGA

SEQ ID NO: 201364 - protein, 11 aa, Homo Sapiens
YLNDHLEPWIQ

SEQ ID NO: 201365 - protein, 11 aa, Homo Sapiens
SLDAREVIPMA

SEQ ID NO: 201366 - protein, 11 aa, Homo Sapiens
ALREAGDEFEL

SEQ ID NO: 201367 - protein, 11 aa, Homo Sapiens
WFLTGMTVAGV

SEQ ID NO: 201368 - protein, 11 aa, Homo Sapiens
VLVSRIAAWMA

SEQ ID NO: 201369 - protein, 11 aa, Homo Sapiens
VVLLGSLFSRK

SEQ ID NO: 201370 - protein, 11 aa, Homo Sapiens
VVLLGSLFSRK

SEQ ID NO: 201371 - protein, 11 aa, Homo Sapiens
GVVLLGSLFSR

SEQ ID NO: 201372 - protein, 11 aa, Homo Sapiens
ATGHSSSLDAR

SEQ ID NO: 201373 - protein, 11 aa, Homo Sapiens
RELVVDFLSYK

SEQ ID NO: 201374 - protein, 11 aa, Homo Sapiens
NWGRIVAFFSF

SEQ ID NO: 201375 - protein, 11 aa, Homo Sapiens
TYLNDHLEPWI

SEQ ID NO: 201376 - protein, 11 aa, Homo Sapiens
AWMATYLNDHL

SEQ ID NO: 201377 - protein, 11 aa, Homo Sapiens
SYKLSQKGYSW

SEQ ID NO: 201378 - protein, 11 aa, Homo Sapiens
NWGRIVAFFSF

SEQ ID NO: 201379 - protein, 11 aa, Homo Sapiens
TYLNDHLEPWI

SEQ ID NO: 201380 - protein, 11 aa, Homo Sapiens
AWMATYLNDHL

SEQ ID NO: 201381 - protein, 11 aa, Homo Sapiens
TYLNDHLEPWI

SEQ ID NO: 201382 - protein, 11 aa, Homo Sapiens
AWMATYLNDHL

SEQ ID NO: 201383 - protein, 11 aa, Homo Sapiens
SYKLSQKGYSW

SEQ ID NO: 201384 - protein, 11 aa, Homo Sapiens
HITPGTAYQSF

SEQ ID NO: 201385 - protein, 11 aa, Homo Sapiens
QVLVSRIAAWM

SEQ ID NO: 201386 - protein, 11 aa, Homo Sapiens
HITPGTAYQSF

SEQ ID NO: 201387 - protein, 11 aa, Homo Sapiens
WIQENGGWDTF

SEQ ID NO: 201388 - protein, 11 aa, Homo Sapiens
FLSYKLSQKGY

SEQ ID NO: 201389 - protein, 11 aa, Homo Sapiens
DGVNWGRIVAF

SEQ ID NO: 201390 - protein, 11 aa, Homo Sapiens
TVAGVVLLGSL

SEQ ID NO: 201391 - protein, 11 aa, Homo Sapiens
SQLHITPGTAY

SEQ ID NO: 201392 - protein, 11 aa, Homo Sapiens
VVLLGSLFSRK

SEQ ID NO: 201393 - protein, 11 aa, Homo Sapiens
RYRRAFSDLTS

SEQ ID NO: 201394 - protein, 11 aa, Homo Sapiens
GVVLLGSLFSR

SEQ ID NO: 201395 - protein, 11 aa, Homo Sapiens
SFEQVVNELFR

SEQ ID NO: 201396 - protein, 11 aa, Homo Sapiens
ESRKGQERFNR

SEQ ID NO: 201397 - protein, 11 aa, Homo Sapiens
ATGHSSSLDAR

SEQ ID NO: 201398 - protein, 11 aa, Homo Sapiens
RELVVDFLSYK

SEQ ID NO: 201399 - protein, 11 aa, Homo Sapiens
LYGNNAAAESR

SEQ ID NO: 201400 - protein, 11 aa, Homo Sapiens
ESRKGQERFNR

SEQ ID NO: 201401 - protein, 11 aa, Homo Sapiens
ELFRDGVNWGR

SEQ ID NO: 201402 - protein, 11 aa, Homo Sapiens
EAGDEFELRYR

SEQ ID NO: 201403 - protein, 11 aa, Homo Sapiens
SFEQVVNELFR

SEQ ID NO: 201404 - protein, 11 aa, Homo Sapiens
GVVLLGSLFSR

SEQ ID NO: 201405 - protein, 11 aa, Homo Sapiens
EFELRYRRAFS

SEQ ID NO: 201406 - protein, 11 aa, Homo Sapiens
ELFRDGVNWGR

SEQ ID NO: 201407 - protein, 11 aa, Homo Sapiens
WSQFSDVEENR

SEQ ID NO: 201408 - protein, 11 aa, Homo Sapiens
ESRKGQERFNR

SEQ ID NO: 201409 - protein, 11 aa, Homo Sapiens
EAGDEFELRYR

SEQ ID NO: 201410 - protein, 11 aa, Homo Sapiens
GVVLLGSLFSR

SEQ ID NO: 201411 - protein, 11 aa, Homo Sapiens
IPMAAVKQALR

SEQ ID NO: 201412 - protein, 11 aa, Homo Sapiens
SFEQVVNELFR

SEQ ID NO: 201413 - protein, 11 aa, Homo Sapiens
TVAGVVLLGSL

SEQ ID NO: 201414 - protein, 11 aa, Homo Sapiens
QVVNELFRDGV

SEQ ID NO: 201415 - protein, 11 aa, Homo Sapiens
IVAFFSFGGAL

SEQ ID NO: 201416 - protein, 11 aa, Homo Sapiens
ESVDKEMQVLV

SEQ ID NO: 201417 - protein, 11 aa, Homo Sapiens
TGMTVAGVVLL

SEQ ID NO: 201418 - protein, 11 aa, Homo Sapiens
ELVVDFLSYKL

SEQ ID NO: 201419 - protein, 11 aa, Homo Sapiens
RIVAFFSFGGA

SEQ ID NO: 201420 - protein, 11 aa, Homo Sapiens
DTFVELYGNNA

SEQ ID NO: 201421 - protein, 11 aa, Homo Sapiens
EVIPMAAVKQA

SEQ ID NO: 201422 - protein, 11 aa, Homo Sapiens
GTAYQSFEQVV

SEQ ID NO: 201423 - protein, 11 aa, Homo Sapiens
DAREVIPMAAV

SEQ ID NO: 201424 - protein, 11 aa, Homo Sapiens
HLADSPAVNGA

SEQ ID NO: 201425 - protein, 11 aa, Homo Sapiens
MTVAGVVLLGS

SEQ ID NO: 201426 - protein, 11 aa, Homo Sapiens
ETPSAINGNPS

SEQ ID NO: 201427 - protein, 11 aa, Homo Sapiens
FLTGMTVAGVV

SEQ ID NO: 201428 - protein, 11 aa, Homo Sapiens
HSSSLDAREVI

SEQ ID NO: 201429 - protein, 11 aa, Homo Sapiens
SAINGNPSWHL

SEQ ID NO: 201430 - protein, 11 aa, Homo Sapiens
DAREVIPMAAV

SEQ ID NO: 201431 - protein, 11 aa, Homo Sapiens
ESVDKEMQVLV

SEQ ID NO: 201432 - protein, 11 aa, Homo Sapiens
HLADSPAVNGA

SEQ ID NO: 201433 - protein, 11 aa, Homo Sapiens
PSWHLADSPAV

SEQ ID NO: 201434 - protein, 11 aa, Homo Sapiens
WFLTGMTVAGV

SEQ ID NO: 201435 - protein, 11 aa, Homo Sapiens
EVIPMAAVKQA

SEQ ID NO: 201436 - protein, 11 aa, Homo Sapiens
ELVVDFLSYKL

SEQ ID NO: 201437 - protein, 11 aa, Homo Sapiens
TVAGVVLLGSL

SEQ ID NO: 201438 - protein, 11 aa, Homo Sapiens
DTFVELYGNNA

SEQ ID NO: 201439 - protein, 11 aa, Homo Sapiens
IVAFFSFGGAL

SEQ ID NO: 201440 - protein, 11 aa, Homo Sapiens
NPSWHLADSPA

SEQ ID NO: 201441 - protein, 11 aa, Homo Sapiens
SPAVNGATGHS

SEQ ID NO: 201442 - protein, 11 aa, Homo Sapiens
SQLHITPGTAY

SEQ ID NO: 201443 - protein, 11 aa, Homo Sapiens
KQALREAGDEF

SEQ ID NO: 201444 - protein, 11 aa, Homo Sapiens
SQSNRELVVDF

SEQ ID NO: 201445 - protein, 11 aa, Homo Sapiens
YQSFEQVVNEL

SEQ ID NO: 201446 - protein, 11 aa, Homo Sapiens
MQVLVSRIAAW

SEQ ID NO: 201447 - protein, 11 aa, Homo Sapiens
VSRIAAWMATY

SEQ ID NO: 201448 - protein, 11 aa, Homo Sapiens
FLSYKLSQKGY

SEQ ID NO: 201449 - protein, 11 aa, Homo Sapiens
WIQENGGWDTF

SEQ ID NO: 201450 - protein, 11 aa, Homo Sapiens
QSFEQVVNELF

SEQ ID NO: 201451 - protein, 11 aa, Homo Sapiens
HITPGTAYQSF

SEQ ID NO: 201452 - protein, 11 aa, Homo Sapiens
GVNWGRIVAFF

SEQ ID NO: 201453 - protein, 11 aa, Homo Sapiens
DEFELRYRRAF

SEQ ID NO: 201454 - protein, 11 aa, Homo Sapiens
REAGDEFELRY

SEQ ID NO: 201455 - protein, 11 aa, Homo Sapiens
SQLHITPGTAY

SEQ ID NO: 201456 - protein, 11 aa, Homo Sapiens
VESVDKEMQVL

SEQ ID NO: 201457 - protein, 11 aa, Homo Sapiens
LEPWIQENGGW

SEQ ID NO: 201458 - protein, 11 aa, Homo Sapiens
FNRWFLTGMTV

SEQ ID NO: 201459 - protein, 11 aa, Homo Sapiens
RRAFSDLTSQL

SEQ ID NO: 201460 - protein, 11 aa, Homo Sapiens
SRIAAWMATYL

SEQ ID NO: 201461 - protein, 11 aa, Homo Sapiens
NPSWHLADSPA

SEQ ID NO: 201462 - protein, 11 aa, Homo Sapiens
TPSAINGNPSW

SEQ ID NO: 201463 - protein, 11 aa, Homo Sapiens
WIQENGGWDTF

SEQ ID NO: 201464 - protein, 11 aa, Homo Sapiens
DGVNWGRIVAF

SEQ ID NO: 201465 - protein, 11 aa, Homo Sapiens
YQSFEQVVNEL

SEQ ID NO: 201466 - protein, 11 aa, Homo Sapiens
VESVDKEMQVL

SEQ ID NO: 201467 - protein, 11 aa, Homo Sapiens
TESEMETPSAI

SEQ ID NO: 201468 - protein, 11 aa, Homo Sapiens
EENRTEAPEGT

SEQ ID NO: 201469 - protein, 11 aa, Homo Sapiens
TPSAINGNPSW

SEQ ID NO: 201470 - protein, 11 aa, Homo Sapiens
NPSWHLADSPA

SEQ ID NO: 201471 - protein, 11 aa, Homo Sapiens
ATYLNDHLEPW

SEQ ID NO: 201472 - protein, 11 aa, Homo Sapiens
ATYLNDHLEPW

SEQ ID NO: 201473 - protein, 11 aa, Homo Sapiens
QSFEQVVNELF

SEQ ID NO: 201474 - protein, 15 aa, Homo Sapiens
RWFLTGMTVAGVVLL

SEQ ID NO: 201475 - protein, 9 aa, Homo Sapiens
LTGMTVAGV

SEQ ID NO: 201476 - protein, 15 aa, Homo Sapiens
RFNRWFLTGMTVAGV

SEQ ID NO: 201477 - protein, 9 aa, Homo Sapiens
FLTGMTVAG

SEQ ID NO: 201478 - protein, 15 aa, Homo Sapiens
FNRWFLTGMTVAGVV

SEQ ID NO: 201479 - protein, 9 aa, Homo Sapiens
LTGMTVAGV

SEQ ID NO: 201480 - protein, 15 aa, Homo Sapiens
NRWFLTGMTVAGVVL

SEQ ID NO: 201481 - protein, 9 aa, Homo Sapiens
LTGMTVAGV

SEQ ID NO: 201482 - protein, 15 aa, Homo Sapiens
WFLTGMTVAGVVLLG

SEQ ID NO: 201483 - protein, 9 aa, Homo Sapiens
LTGMTVAGV

SEQ ID NO: 201484 - protein, 15 aa, Homo Sapiens
DAREVIPMAAVKQAL

SEQ ID NO: 201485 - protein, 9 aa, Homo Sapiens
VIPMAAVKQ

SEQ ID NO: 201486 - protein, 15 aa, Homo Sapiens
AREVIPMAAVKQALR

SEQ ID NO: 201487 - protein, 9 aa, Homo Sapiens
VIPMAAVKQ

SEQ ID NO: 201488 - protein, 15 aa, Homo Sapiens
REVIPMAAVKQALRE

SEQ ID NO: 201489 - protein, 9 aa, Homo Sapiens
VIPMAAVKQ

SEQ ID NO: 201490 - protein, 15 aa, Homo Sapiens
LDAREVIPMAAVKQA

SEQ ID NO: 201491 - protein, 9 aa, Homo Sapiens
VIPMAAVKQ

SEQ ID NO: 201492 - protein, 15 aa, Homo Sapiens
KEMQVLVSRIAAWMA

SEQ ID NO: 201493 - protein, 9 aa, Homo Sapiens
MQVLVSRIA

SEQ ID NO: 201494 - protein, 15 aa, Homo Sapiens
LTSQLHITPGTAYQS

SEQ ID NO: 201495 - protein, 9 aa, Homo Sapiens
LHITPGTAY

SEQ ID NO: 201496 - protein, 15 aa, Homo Sapiens
TSQLHITPGTAYQSF

SEQ ID NO: 201497 - protein, 9 aa, Homo Sapiens
ITPGTAYQS

SEQ ID NO: 201498 - protein, 15 aa, Homo Sapiens
SLDAREVIPMAAVKQ

SEQ ID NO: 201499 - protein, 9 aa, Homo Sapiens
AREVIPMAA

SEQ ID NO: 201500 - protein, 15 aa, Homo Sapiens
SQLHITPGTAYQSFE

SEQ ID NO: 201501 - protein, 9 aa, Homo Sapiens
ITPGTAYQS

SEQ ID NO: 201502 - protein, 15 aa, Homo Sapiens
FLTGMTVAGVVLLGS

SEQ ID NO: 201503 - protein, 9 aa, Homo Sapiens
LTGMTVAGV

SEQ ID NO: 201504 - protein, 15 aa, Homo Sapiens
DKEMQVLVSRIAAWM

SEQ ID NO: 201505 - protein, 9 aa, Homo Sapiens
MQVLVSRIA

SEQ ID NO: 201506 - protein, 15 aa, Homo Sapiens
QLHITPGTAYQSFEQ

SEQ ID NO: 201507 - protein, 9 aa, Homo Sapiens
ITPGTAYQS

SEQ ID NO: 201508 - protein, 15 aa, Homo Sapiens
LHITPGTAYQSFEQV

SEQ ID NO: 201509 - protein, 9 aa, Homo Sapiens
ITPGTAYQS

SEQ ID NO: 201510 - protein, 15 aa, Homo Sapiens
SVDKEMQVLVSRIAA

SEQ ID NO: 201511 - protein, 9 aa, Homo Sapiens
MQVLVSRIA

SEQ ID NO: 201512 - protein, 15 aa, Homo Sapiens
EVIPMAAVKQALREA

SEQ ID NO: 201513 - protein, 9 aa, Homo Sapiens
IPMAAVKQA

SEQ ID NO: 201514 - protein, 15 aa, Homo Sapiens
ESVDKEMQVLVSRIA

SEQ ID NO: 201515 - protein, 9 aa, Homo Sapiens
VDKEMQVLV

SEQ ID NO: 201516 - protein, 15 aa, Homo Sapiens
VDKEMQVLVSRIAAW

SEQ ID NO: 201517 - protein, 9 aa, Homo Sapiens
MQVLVSRIA

SEQ ID NO: 201518 - protein, 15 aa, Homo Sapiens
LTGMTVAGVVLLGSL

SEQ ID NO: 201519 - protein, 9 aa, Homo Sapiens
LTGMTVAGV

SEQ ID NO: 201520 - protein, 15 aa, Homo Sapiens
ERFNRWFLTGMTVAG

SEQ ID NO: 201521 - protein, 9 aa, Homo Sapiens
FNRWFLTGM

SEQ ID NO: 201522 - protein, 15 aa, Homo Sapiens
ETPSAINGNPSWHLA

SEQ ID NO: 201523 - protein, 9 aa, Homo Sapiens
INGNPSWHL

SEQ ID NO: 201524 - protein, 15 aa, Homo Sapiens
TPSAINGNPSWHLAD

SEQ ID NO: 201525 - protein, 9 aa, Homo Sapiens
INGNPSWHL

SEQ ID NO: 201526 - protein, 15 aa, Homo Sapiens
PSAINGNPSWHLADS

SEQ ID NO: 201527 - protein, 9 aa, Homo Sapiens
INGNPSWHL

SEQ ID NO: 201528 - protein, 15 aa, Homo Sapiens
SAINGNPSWHLADSP

SEQ ID NO: 201529 - protein, 9 aa, Homo Sapiens
INGNPSWHL

SEQ ID NO: 201530 - protein, 15 aa, Homo Sapiens
METPSAINGNPSWHL

SEQ ID NO: 201531 - protein, 9 aa, Homo Sapiens
PSAINGNPS

SEQ ID NO: 201532 - protein, 15 aa, Homo Sapiens
EMQVLVSRIAAWMAT

SEQ ID NO: 201533 - protein, 9 aa, Homo Sapiens
MQVLVSRIA

SEQ ID NO: 201534 - protein, 15 aa, Homo Sapiens
VIPMAAVKQALREAG

SEQ ID NO: 201535 - protein, 9 aa, Homo Sapiens
VIPMAAVKQ

SEQ ID NO: 201536 - protein, 15 aa, Homo Sapiens
MQVLVSRIAAWMATY

SEQ ID NO: 201537 - protein, 9 aa, Homo Sapiens
MQVLVSRIA

SEQ ID NO: 201538 - protein, 15 aa, Homo Sapiens
VLVSRIAAWMATYLN

SEQ ID NO: 201539 - protein, 9 aa, Homo Sapiens
IAAWMATYL

SEQ ID NO: 201540 - protein, 15 aa, Homo Sapiens
GMTVAGVVLLGSLFS

SEQ ID NO: 201541 - protein, 9 aa, Homo Sapiens
MTVAGVVLL

SEQ ID NO: 201542 - protein, 15 aa, Homo Sapiens
MTVAGVVLLGSLFSR

SEQ ID NO: 201543 - protein, 9 aa, Homo Sapiens
VVLLGSLFS

SEQ ID NO: 201544 - protein, 15 aa, Homo Sapiens
INGNPSWHLADSPAV

SEQ ID NO: 201545 - protein, 9 aa, Homo Sapiens
INGNPSWHL

SEQ ID NO: 201546 - protein, 15 aa, Homo Sapiens
VELYGNNAAAESRKG

SEQ ID NO: 201547 - protein, 9 aa, Homo Sapiens
YGNNAAAES

SEQ ID NO: 201548 - protein, 15 aa, Homo Sapiens
TVAGVVLLGSLFSRK

SEQ ID NO: 201549 - protein, 9 aa, Homo Sapiens
VVLLGSLFS

SEQ ID NO: 201550 - protein, 15 aa, Homo Sapiens
QVLVSRIAAWMATYL

SEQ ID NO: 201551 - protein, 9 aa, Homo Sapiens
VSRIAAWMA

SEQ ID NO: 201552 - protein, 15 aa, Homo Sapiens
FVELYGNNAAAESRK

SEQ ID NO: 201553 - protein, 9 aa, Homo Sapiens
YGNNAAAES

SEQ ID NO: 201554 - protein, 15 aa, Homo Sapiens
ELYGNNAAAESRKGQ

SEQ ID NO: 201555 - protein, 9 aa, Homo Sapiens
YGNNAAAES

SEQ ID NO: 201556 - protein, 15 aa, Homo Sapiens
LRYRRAFSDLTSQLH

SEQ ID NO: 201557 - protein, 9 aa, Homo Sapiens
YRRAFSDLT

SEQ ID NO: 201558 - protein, 15 aa, Homo Sapiens
LVSRIAAWMATYLND

SEQ ID NO: 201559 - protein, 9 aa, Homo Sapiens
IAAWMATYL

SEQ ID NO: 201560 - protein, 15 aa, Homo Sapiens
TFVELYGNNAAAESR

SEQ ID NO: 201561 - protein, 9 aa, Homo Sapiens
YGNNAAAES

SEQ ID NO: 201562 - protein, 15 aa, Homo Sapiens
DTFVELYGNNAAAES

SEQ ID NO: 201563 - protein, 9 aa, Homo Sapiens
FVELYGNNA

SEQ ID NO: 201564 - protein, 15 aa, Homo Sapiens
NPSWHLADSPAVNGA

SEQ ID NO: 201565 - protein, 9 aa, Homo Sapiens
WHLADSPAV

SEQ ID NO: 201566 - protein, 15 aa, Homo Sapiens
PSWHLADSPAVNGAT

SEQ ID NO: 201567 - protein, 9 aa, Homo Sapiens
WHLADSPAV

SEQ ID NO: 201568 - protein, 15 aa, Homo Sapiens
TGMTVAGVVLLGSLF

SEQ ID NO: 201569 - protein, 9 aa, Homo Sapiens
MTVAGVVLL

SEQ ID NO: 201570 - protein, 15 aa, Homo Sapiens
VSRIAAWMATYLNDH

SEQ ID NO: 201571 - protein, 9 aa, Homo Sapiens
IAAWMATYL

SEQ ID NO: 201572 - protein, 15 aa, Homo Sapiens
GNPSWHLADSPAVNG

SEQ ID NO: 201573 - protein, 9 aa, Homo Sapiens
WHLADSPAV

SEQ ID NO: 201574 - protein, 15 aa, Homo Sapiens
LADSPAVNGATGHSS

SEQ ID NO: 201575 - protein, 9 aa, Homo Sapiens
LADSPAVNG

SEQ ID NO: 201576 - protein, 15 aa, Homo Sapiens
ELRYRRAFSDLTSQL

SEQ ID NO: 201577 - protein, 9 aa, Homo Sapiens
YRRAFSDLT

SEQ ID NO: 201578 - protein, 15 aa, Homo Sapiens
SRIAAWMATYLNDHL

SEQ ID NO: 201579 - protein, 9 aa, Homo Sapiens
IAAWMATYL

SEQ ID NO: 201580 - protein, 15 aa, Homo Sapiens
FELRYRRAFSDLTSQ

SEQ ID NO: 201581 - protein, 9 aa, Homo Sapiens
YRRAFSDLT

SEQ ID NO: 201582 - protein, 15 aa, Homo Sapiens
EFELRYRRAFSDLTS

SEQ ID NO: 201583 - protein, 9 aa, Homo Sapiens
YRRAFSDLT

SEQ ID NO: 201584 - protein, 15 aa, Homo Sapiens
DEFELRYRRAFSDLT

SEQ ID NO: 201585 - protein, 9 aa, Homo Sapiens
LRYRRAFSD

SEQ ID NO: 201586 - protein, 15 aa, Homo Sapiens
IVAFFSFGGALCVES

SEQ ID NO: 201587 - protein, 9 aa, Homo Sapiens
FSFGGALCV

SEQ ID NO: 201588 - protein, 15 aa, Homo Sapiens
SWHLADSPAVNGATG

SEQ ID NO: 201589 - protein, 9 aa, Homo Sapiens
LADSPAVNG

SEQ ID NO: 201590 - protein, 15 aa, Homo Sapiens
DSPAVNGATGHSSSL

SEQ ID NO: 201591 - protein, 9 aa, Homo Sapiens
VNGATGHSS

SEQ ID NO: 201592 - protein, 15 aa, Homo Sapiens
SPAVNGATGHSSSLD

SEQ ID NO: 201593 - protein, 9 aa, Homo Sapiens
VNGATGHSS

SEQ ID NO: 201594 - protein, 15 aa, Homo Sapiens
VAFFSFGGALCVESV

SEQ ID NO: 201595 - protein, 9 aa, Homo Sapiens
FSFGGALCV

SEQ ID NO: 201596 - protein, 15 aa, Homo Sapiens
ADSPAVNGATGHSSS

SEQ ID NO: 201597 - protein, 9 aa, Homo Sapiens
VNGATGHSS

SEQ ID NO: 201598 - protein, 15 aa, Homo Sapiens
AFFSFGGALCVESVD

SEQ ID NO: 201599 - protein, 9 aa, Homo Sapiens
FSFGGALCV

SEQ ID NO: 201600 - protein, 15 aa, Homo Sapiens
WHLADSPAVNGATGH

SEQ ID NO: 201601 - protein, 9 aa, Homo Sapiens
LADSPAVNG

SEQ ID NO: 201602 - protein, 15 aa, Homo Sapiens
HITPGTAYQSFEQVV

SEQ ID NO: 201603 - protein, 9 aa, Homo Sapiens
ITPGTAYQS

SEQ ID NO: 201604 - protein, 15 aa, Homo Sapiens
ITPGTAYQSFEQVVN

SEQ ID NO: 201605 - protein, 9 aa, Homo Sapiens
ITPGTAYQS

SEQ ID NO: 201606 - protein, 15 aa, Homo Sapiens
AINGNPSWHLADSPA

SEQ ID NO: 201607 - protein, 9 aa, Homo Sapiens
INGNPSWHL

SEQ ID NO: 201608 - protein, 15 aa, Homo Sapiens
PAVNGATGHSSSLDA

SEQ ID NO: 201609 - protein, 9 aa, Homo Sapiens
VNGATGHSS

SEQ ID NO: 201610 - protein, 15 aa, Homo Sapiens
RYRRAFSDLTSQLHI

SEQ ID NO: 201611 - protein, 9 aa, Homo Sapiens
YRRAFSDLT

SEQ ID NO: 201612 - protein, 15 aa, Homo Sapiens
YRRAFSDLTSQLHIT

SEQ ID NO: 201613 - protein, 9 aa, Homo Sapiens
YRRAFSDLT

SEQ ID NO: 201614 - protein, 15 aa, Homo Sapiens
NGNPSWHLADSPAVN

SEQ ID NO: 201615 - protein, 9 aa, Homo Sapiens
WHLADSPAV

SEQ ID NO: 201616 - protein, 15 aa, Homo Sapiens
GRIVAFFSFGGALCV

SEQ ID NO: 201617 - protein, 9 aa, Homo Sapiens
IVAFFSFGG

SEQ ID NO: 201618 - protein, 15 aa, Homo Sapiens
LYGNNAAAESRKGQE

SEQ ID NO: 201619 - protein, 9 aa, Homo Sapiens
YGNNAAAES

SEQ ID NO: 201620 - protein, 15 aa, Homo Sapiens
RIAAWMATYLNDHLE

SEQ ID NO: 201621 - protein, 9 aa, Homo Sapiens
AAWMATYLN

SEQ ID NO: 201622 - protein, 15 aa, Homo Sapiens
YGNNAAAESRKGQER

SEQ ID NO: 201623 - protein, 9 aa, Homo Sapiens
YGNNAAAES

SEQ ID NO: 201624 - protein, 15 aa, Homo Sapiens
RIVAFFSFGGALCVE

SEQ ID NO: 201625 - protein, 9 aa, Homo Sapiens
FSFGGALCV

SEQ ID NO: 201626 - protein, 15 aa, Homo Sapiens
FRDGVNWGRIVAFFS

SEQ ID NO: 201627 - protein, 9 aa, Homo Sapiens
VNWGRIVAF

SEQ ID NO: 201628 - protein, 15 aa, Homo Sapiens
FFSFGGALCVESVDK

SEQ ID NO: 201629 - protein, 9 aa, Homo Sapiens
FSFGGALCV

SEQ ID NO: 201630 - protein, 15 aa, Homo Sapiens
FSFGGALCVESVDKE

SEQ ID NO: 201631 - protein, 9 aa, Homo Sapiens
FSFGGALCV

SEQ ID NO: 201632 - protein, 15 aa, Homo Sapiens
RDGVNWGRIVAFFSF

SEQ ID NO: 201633 - protein, 9 aa, Homo Sapiens
VNWGRIVAF

SEQ ID NO: 201634 - protein, 15 aa, Homo Sapiens
DGVNWGRIVAFFSFG

SEQ ID NO: 201635 - protein, 9 aa, Homo Sapiens
VNWGRIVAF

SEQ ID NO: 201636 - protein, 15 aa, Homo Sapiens
IPMAAVKQALREAGD

SEQ ID NO: 201637 - protein, 9 aa, Homo Sapiens
IPMAAVKQA

SEQ ID NO: 201638 - protein, 15 aa, Homo Sapiens
RRAFSDLTSQLHITP

SEQ ID NO: 201639 - protein, 9 aa, Homo Sapiens
FSDLTSQLH

SEQ ID NO: 201640 - protein, 15 aa, Homo Sapiens
RAFSDLTSQLHITPG

SEQ ID NO: 201641 - protein, 9 aa, Homo Sapiens
FSDLTSQLH

SEQ ID NO: 201642 - protein, 15 aa, Homo Sapiens
HLADSPAVNGATGHS

SEQ ID NO: 201643 - protein, 9 aa, Homo Sapiens
LADSPAVNG

SEQ ID NO: 201644 - protein, 15 aa, Homo Sapiens
GVNWGRIVAFFSFGG

SEQ ID NO: 201645 - protein, 9 aa, Homo Sapiens
VNWGRIVAF

SEQ ID NO: 201646 - protein, 14 aa, Homo Sapiens
AAWMATYLNDHLEP

SEQ ID NO: 201647 - protein, 9 aa, Homo Sapiens
IAAWMATYL

SEQ ID NO: 201648 - protein, 15 aa, Homo Sapiens
AVNGATGHSSSLDAR

SEQ ID NO: 201649 - protein, 9 aa, Homo Sapiens
VNGATGHSS

SEQ ID NO: 201650 - protein, 15 aa, Homo Sapiens
VNWGRIVAFFSFGGA

SEQ ID NO: 201651 - protein, 9 aa, Homo Sapiens
VNWGRIVAF

SEQ ID NO: 201652 - protein, 15 aa, Homo Sapiens
ELVVDFLSYKLSQKG

SEQ ID NO: 201653 - protein, 9 aa, Homo Sapiens
VVDFLSYKL

SEQ ID NO: 201654 - protein, 15 aa, Homo Sapiens
ELFRDGVNWGRIVAF

SEQ ID NO: 201655 - protein, 9 aa, Homo Sapiens
FRDGVNWGR

SEQ ID NO: 201656 - protein, 15 aa, Homo Sapiens
VNGATGHSSSLDARE

SEQ ID NO: 201657 - protein, 9 aa, Homo Sapiens
VNGATGHSS

SEQ ID NO: 201658 - protein, 15 aa, Homo Sapiens
LFRDGVNWGRIVAFF

SEQ ID NO: 201659 - protein, 9 aa, Homo Sapiens
VNWGRIVAF

SEQ ID NO: 201660 - protein, 15 aa, Homo Sapiens
LVVDFLSYKLSQKGY

SEQ ID NO: 201661 - protein, 9 aa, Homo Sapiens
LSYKLSQKG

SEQ ID NO: 201662 - protein, 15 aa, Homo Sapiens
VVDFLSYKLSQKGYS

SEQ ID NO: 201663 - protein, 9 aa, Homo Sapiens
LSYKLSQKG

SEQ ID NO: 201664 - protein, 15 aa, Homo Sapiens
QERFNRWFLTGMTVA

SEQ ID NO: 201665 - protein, 9 aa, Homo Sapiens
FNRWFLTGM

SEQ ID NO: 201666 - protein, 15 aa, Homo Sapiens
ESEMETPSAINGNPS

SEQ ID NO: 201667 - protein, 9 aa, Homo Sapiens
METPSAING

SEQ ID NO: 201668 - protein, 15 aa, Homo Sapiens
GTESEMETPSAINGN

SEQ ID NO: 201669 - protein, 9 aa, Homo Sapiens
METPSAING

SEQ ID NO: 201670 - protein, 15 aa, Homo Sapiens
DLTSQLHITPGTAYQ

SEQ ID NO: 201671 - protein, 9 aa, Homo Sapiens
LHITPGTAY

SEQ ID NO: 201672 - protein, 15 aa, Homo Sapiens
EGTESEMETPSAING

SEQ ID NO: 201673 - protein, 9 aa, Homo Sapiens
ESEMETPSA

SEQ ID NO: 201674 - protein, 15 aa, Homo Sapiens
SEMETPSAINGNPSW

SEQ ID NO: 201675 - protein, 9 aa, Homo Sapiens
METPSAING

SEQ ID NO: 201676 - protein, 15 aa, Homo Sapiens
SDLTSQLHITPGTAY

SEQ ID NO: 201677 - protein, 9 aa, Homo Sapiens
SQLHITPGT

SEQ ID NO: 201678 - protein, 15 aa, Homo Sapiens
VDFLSYKLSQKGYSW

SEQ ID NO: 201679 - protein, 9 aa, Homo Sapiens
LSYKLSQKG

SEQ ID NO: 201680 - protein, 15 aa, Homo Sapiens
TESEMETPSAINGNP

SEQ ID NO: 201681 - protein, 9 aa, Homo Sapiens
METPSAING

SEQ ID NO: 201682 - protein, 15 aa, Homo Sapiens
AAWMATYLNDHLEPW

SEQ ID NO: 201683 - protein, 9 aa, Homo Sapiens
AAWMATYLN

SEQ ID NO: 201684 - protein, 15 aa, Homo Sapiens
DFLSYKLSQKGYSWS

SEQ ID NO: 201685 - protein, 9 aa, Homo Sapiens
LSYKLSQKG

SEQ ID NO: 201686 - protein, 15 aa, Homo Sapiens
AFSDLTSQLHITPGT

SEQ ID NO: 201687 - protein, 9 aa, Homo Sapiens
FSDLTSQLH

SEQ ID NO: 201688 - protein, 15 aa, Homo Sapiens
FSDLTSQLHITPGTA

SEQ ID NO: 201689 - protein, 9 aa, Homo Sapiens
FSDLTSQLH

SEQ ID NO: 201690 - protein, 15 aa, Homo Sapiens
WGRIVAFFSFGGALC

SEQ ID NO: 201691 - protein, 9 aa, Homo Sapiens
IVAFFSFGG

SEQ ID NO: 201692 - protein, 15 aa, Homo Sapiens
GQERFNRWFLTGMTV

SEQ ID NO: 201693 - protein, 9 aa, Homo Sapiens
FNRWFLTGM

SEQ ID NO: 201694 - protein, 15 aa, Homo Sapiens
LRYRRAFSDLTSQLH

SEQ ID NO: 201695 - protein, 9 aa, Homo Sapiens
YRRAFSDLT

SEQ ID NO: 201696 - protein, 15 aa, Homo Sapiens
FELRYRRAFSDLTSQ

SEQ ID NO: 201697 - protein, 9 aa, Homo Sapiens
YRRAFSDLT

SEQ ID NO: 201698 - protein, 15 aa, Homo Sapiens
EFELRYRRAFSDLTS

SEQ ID NO: 201699 - protein, 9 aa, Homo Sapiens
YRRAFSDLT

SEQ ID NO: 201700 - protein, 15 aa, Homo Sapiens
DEFELRYRRAFSDLT

SEQ ID NO: 201701 - protein, 9 aa, Homo Sapiens
DEFELRYRR

SEQ ID NO: 201702 - protein, 15 aa, Homo Sapiens
ELRYRRAFSDLTSQL

SEQ ID NO: 201703 - protein, 9 aa, Homo Sapiens
YRRAFSDLT

SEQ ID NO: 201704 - protein, 15 aa, Homo Sapiens
NGGWDTFVELYGNNA

SEQ ID NO: 201705 - protein, 9 aa, Homo Sapiens
WDTFVELYG

SEQ ID NO: 201706 - protein, 15 aa, Homo Sapiens
GGWDTFVELYGNNAA

SEQ ID NO: 201707 - protein, 9 aa, Homo Sapiens
FVELYGNNA

SEQ ID NO: 201708 - protein, 15 aa, Homo Sapiens
WDTFVELYGNNAAAE

SEQ ID NO: 201709 - protein, 9 aa, Homo Sapiens
FVELYGNNA

SEQ ID NO: 201710 - protein, 15 aa, Homo Sapiens
GWDTFVELYGNNAAA

SEQ ID NO: 201711 - protein, 9 aa, Homo Sapiens
FVELYGNNA

SEQ ID NO: 201712 - protein, 15 aa, Homo Sapiens
DTFVELYGNNAAAES

SEQ ID NO: 201713 - protein, 9 aa, Homo Sapiens
FVELYGNNA

SEQ ID NO: 201714 - protein, 15 aa, Homo Sapiens
RYRRAFSDLTSQLHI

SEQ ID NO: 201715 - protein, 9 aa, Homo Sapiens
YRRAFSDLT

SEQ ID NO: 201716 - protein, 15 aa, Homo Sapiens
YRRAFSDLTSQLHIT

SEQ ID NO: 201717 - protein, 9 aa, Homo Sapiens
YRRAFSDLT

SEQ ID NO: 201718 - protein, 15 aa, Homo Sapiens
ESVDKEMQVLVSRIA

SEQ ID NO: 201719 - protein, 9 aa, Homo Sapiens
KEMQVLVSR

SEQ ID NO: 201720 - protein, 15 aa, Homo Sapiens
VDKEMQVLVSRIAAW

SEQ ID NO: 201721 - protein, 9 aa, Homo Sapiens
MQVLVSRIA

SEQ ID NO: 201722 - protein, 15 aa, Homo Sapiens
ERFNRWFLTGMTVAG

SEQ ID NO: 201723 - protein, 9 aa, Homo Sapiens
WFLTGMTVA

SEQ ID NO: 201724 - protein, 15 aa, Homo Sapiens
SVDKEMQVLVSRIAA

SEQ ID NO: 201725 - protein, 9 aa, Homo Sapiens
MQVLVSRIA

SEQ ID NO: 201726 - protein, 15 aa, Homo Sapiens
RFNRWFLTGMTVAGV

SEQ ID NO: 201727 - protein, 9 aa, Homo Sapiens
FLTGMTVAG

SEQ ID NO: 201728 - protein, 15 aa, Homo Sapiens
FNRWFLTGMTVAGVV

SEQ ID NO: 201729 - protein, 9 aa, Homo Sapiens
FLTGMTVAG

SEQ ID NO: 201730 - protein, 15 aa, Homo Sapiens
KEMQVLVSRIAAWMA

SEQ ID NO: 201731 - protein, 9 aa, Homo Sapiens
MQVLVSRIA

SEQ ID NO: 201732 - protein, 15 aa, Homo Sapiens
DKEMQVLVSRIAAWM

SEQ ID NO: 201733 - protein, 9 aa, Homo Sapiens
MQVLVSRIA

SEQ ID NO: 201734 - protein, 15 aa, Homo Sapiens
NRWFLTGMTVAGVVL

SEQ ID NO: 201735 - protein, 9 aa, Homo Sapiens
FLTGMTVAG

SEQ ID NO: 201736 - protein, 15 aa, Homo Sapiens
AAWMATYLNDHLEPW

SEQ ID NO: 201737 - protein, 9 aa, Homo Sapiens
WMATYLNDH

SEQ ID NO: 201738 - protein, 15 aa, Homo Sapiens
SRIAAWMATYLNDHL

SEQ ID NO: 201739 - protein, 9 aa, Homo Sapiens
WMATYLNDH

SEQ ID NO: 201740 - protein, 15 aa, Homo Sapiens
RIAAWMATYLNDHLE

SEQ ID NO: 201741 - protein, 9 aa, Homo Sapiens
WMATYLNDH

SEQ ID NO: 201742 - protein, 15 aa, Homo Sapiens
IAAWMATYLNDHLEP

SEQ ID NO: 201743 - protein, 9 aa, Homo Sapiens
WMATYLNDH

SEQ ID NO: 201744 - protein, 15 aa, Homo Sapiens
VSRIAAWMATYLNDH

SEQ ID NO: 201745 - protein, 9 aa, Homo Sapiens
AAWMATYLN

SEQ ID NO: 201746 - protein, 15 aa, Homo Sapiens
TVAGVVLLGSLFSRK

SEQ ID NO: 201747 - protein, 9 aa, Homo Sapiens
VVLLGSLFS

SEQ ID NO: 201748 - protein, 15 aa, Homo Sapiens
RFNRWFLTGMTVAGV

SEQ ID NO: 201749 - protein, 9 aa, Homo Sapiens
FLTGMTVAG

SEQ ID NO: 201750 - protein, 15 aa, Homo Sapiens
FNRWFLTGMTVAGVV

SEQ ID NO: 201751 - protein, 9 aa, Homo Sapiens
FLTGMTVAG

SEQ ID NO: 201752 - protein, 15 aa, Homo Sapiens
NRWFLTGMTVAGVVL

SEQ ID NO: 201753 - protein, 9 aa, Homo Sapiens
FLTGMTVAG

SEQ ID NO: 201754 - protein, 15 aa, Homo Sapiens
ERFNRWFLTGMTVAG

SEQ ID NO: 201755 - protein, 9 aa, Homo Sapiens
WFLTGMTVA

SEQ ID NO: 201756 - protein, 15 aa, Homo Sapiens
AWMATYLNDHLEPWI

SEQ ID NO: 201757 - protein, 9 aa, Homo Sapiens
WMATYLNDH

SEQ ID NO: 201758 - protein, 15 aa, Homo Sapiens
RWFLTGMTVAGVVLL

SEQ ID NO: 201759 - protein, 9 aa, Homo Sapiens
FLTGMTVAG

SEQ ID NO: 201760 - protein, 15 aa, Homo Sapiens
DTFVELYGNNAAAES

SEQ ID NO: 201761 - protein, 9 aa, Homo Sapiens
FVELYGNNA

SEQ ID NO: 201762 - protein, 15 aa, Homo Sapiens
GWDTFVELYGNNAAA

SEQ ID NO: 201763 - protein, 9 aa, Homo Sapiens
FVELYGNNA

SEQ ID NO: 201764 - protein, 15 aa, Homo Sapiens
WMATYLNDHLEPWIQ

SEQ ID NO: 201765 - protein, 9 aa, Homo Sapiens
WMATYLNDH

SEQ ID NO: 201766 - protein, 15 aa, Homo Sapiens
WDTFVELYGNNAAAE

SEQ ID NO: 201767 - protein, 9 aa, Homo Sapiens
FVELYGNNA

SEQ ID NO: 201768 - protein, 15 aa, Homo Sapiens
GGWDTFVELYGNNAA

SEQ ID NO: 201769 - protein, 9 aa, Homo Sapiens
FVELYGNNA

SEQ ID NO: 201770 - protein, 15 aa, Homo Sapiens
NGGWDTFVELYGNNA

SEQ ID NO: 201771 - protein, 9 aa, Homo Sapiens
GWDTFVELY

SEQ ID NO: 201772 - protein, 15 aa, Homo Sapiens
TAYQSFEQVVNELFR

SEQ ID NO: 201773 - protein, 9 aa, Homo Sapiens
YQSFEQVVN

SEQ ID NO: 201774 - protein, 15 aa, Homo Sapiens
GTAYQSFEQVVNELF

SEQ ID NO: 201775 - protein, 9 aa, Homo Sapiens
YQSFEQVVN

SEQ ID NO: 201776 - protein, 15 aa, Homo Sapiens
TPGTAYQSFEQVVNE

SEQ ID NO: 201777 - protein, 9 aa, Homo Sapiens
YQSFEQVVN

SEQ ID NO: 201778 - protein, 15 aa, Homo Sapiens
PGTAYQSFEQVVNEL

SEQ ID NO: 201779 - protein, 9 aa, Homo Sapiens
YQSFEQVVN

SEQ ID NO: 201780 - protein, 15 aa, Homo Sapiens
ITPGTAYQSFEQVVN

SEQ ID NO: 201781 - protein, 9 aa, Homo Sapiens
AYQSFEQVV

SEQ ID NO: 201782 - protein, 15 aa, Homo Sapiens
VSRIAAWMATYLNDH

SEQ ID NO: 201783 - protein, 9 aa, Homo Sapiens
AAWMATYLN

SEQ ID NO: 201784 - protein, 15 aa, Homo Sapiens
LVSRIAAWMATYLND

SEQ ID NO: 201785 - protein, 9 aa, Homo Sapiens
AAWMATYLN

SEQ ID NO: 201786 - protein, 15 aa, Homo Sapiens
VLVSRIAAWMATYLN

SEQ ID NO: 201787 - protein, 9 aa, Homo Sapiens
IAAWMATYL

SEQ ID NO: 201788 - protein, 15 aa, Homo Sapiens
SRIAAWMATYLNDHL

SEQ ID NO: 201789 - protein, 9 aa, Homo Sapiens
AAWMATYLN

SEQ ID NO: 201790 - protein, 15 aa, Homo Sapiens
LRYRRAFSDLTSQLH

SEQ ID NO: 201791 - protein, 9 aa, Homo Sapiens
YRRAFSDLT

SEQ ID NO: 201792 - protein, 15 aa, Homo Sapiens
FELRYRRAFSDLTSQ

SEQ ID NO: 201793 - protein, 9 aa, Homo Sapiens
YRRAFSDLT

SEQ ID NO: 201794 - protein, 15 aa, Homo Sapiens
EFELRYRRAFSDLTS

SEQ ID NO: 201795 - protein, 9 aa, Homo Sapiens
YRRAFSDLT

SEQ ID NO: 201796 - protein, 15 aa, Homo Sapiens
RIAAWMATYLNDHLE

SEQ ID NO: 201797 - protein, 9 aa, Homo Sapiens
AAWMATYLN

SEQ ID NO: 201798 - protein, 15 aa, Homo Sapiens
AYQSFEQVVNELFRD

SEQ ID NO: 201799 - protein, 9 aa, Homo Sapiens
YQSFEQVVN

SEQ ID NO: 201800 - protein, 15 aa, Homo Sapiens
YQSFEQVVNELFRDG

SEQ ID NO: 201801 - protein, 9 aa, Homo Sapiens
YQSFEQVVN

SEQ ID NO: 201802 - protein, 15 aa, Homo Sapiens
ELRYRRAFSDLTSQL

SEQ ID NO: 201803 - protein, 9 aa, Homo Sapiens
YRRAFSDLT

SEQ ID NO: 201804 - protein, 15 aa, Homo Sapiens
SQKGYSWSQFSDVEE

SEQ ID NO: 201805 - protein, 9 aa, Homo Sapiens
GYSWSQFSD

SEQ ID NO: 201806 - protein, 15 aa, Homo Sapiens
DEFELRYRRAFSDLT

SEQ ID NO: 201807 - protein, 9 aa, Homo Sapiens
LRYRRAFSD

SEQ ID NO: 201808 - protein, 15 aa, Homo Sapiens
QKGYSWSQFSDVEEN

SEQ ID NO: 201809 - protein, 9 aa, Homo Sapiens
WSQFSDVEE

SEQ ID NO: 201810 - protein, 15 aa, Homo Sapiens
RYRRAFSDLTSQLHI

SEQ ID NO: 201811 - protein, 9 aa, Homo Sapiens
YRRAFSDLT

SEQ ID NO: 201812 - protein, 15 aa, Homo Sapiens
KGYSWSQFSDVEENR

SEQ ID NO: 201813 - protein, 9 aa, Homo Sapiens
WSQFSDVEE

SEQ ID NO: 201814 - protein, 15 aa, Homo Sapiens
IAAWMATYLNDHLEP

SEQ ID NO: 201815 - protein, 9 aa, Homo Sapiens
AAWMATYLN

SEQ ID NO: 201816 - protein, 15 aa, Homo Sapiens
GYSWSQFSDVEENRT

SEQ ID NO: 201817 - protein, 9 aa, Homo Sapiens
WSQFSDVEE

SEQ ID NO: 201818 - protein, 15 aa, Homo Sapiens
KEMQVLVSRIAAWMA

SEQ ID NO: 201819 - protein, 9 aa, Homo Sapiens
VLVSRIAAW

SEQ ID NO: 201820 - protein, 15 aa, Homo Sapiens
MQVLVSRIAAWMATY

SEQ ID NO: 201821 - protein, 9 aa, Homo Sapiens
VLVSRIAAW

SEQ ID NO: 201822 - protein, 15 aa, Homo Sapiens
EMQVLVSRIAAWMAT

SEQ ID NO: 201823 - protein, 9 aa, Homo Sapiens
VLVSRIAAW

SEQ ID NO: 201824 - protein, 15 aa, Homo Sapiens
DKEMQVLVSRIAAWM

SEQ ID NO: 201825 - protein, 9 aa, Homo Sapiens
VLVSRIAAW

SEQ ID NO: 201826 - protein, 15 aa, Homo Sapiens
QVLVSRIAAWMATYL

SEQ ID NO: 201827 - protein, 9 aa, Homo Sapiens
VLVSRIAAW

SEQ ID NO: 201828 - protein, 15 aa, Homo Sapiens
ETPSAINGNPSWHLA

SEQ ID NO: 201829 - protein, 9 aa, Homo Sapiens
INGNPSWHL

SEQ ID NO: 201830 - protein, 15 aa, Homo Sapiens
METPSAINGNPSWHL

SEQ ID NO: 201831 - protein, 9 aa, Homo Sapiens
AINGNPSWH

SEQ ID NO: 201832 - protein, 15 aa, Homo Sapiens
VDKEMQVLVSRIAAW

SEQ ID NO: 201833 - protein, 9 aa, Homo Sapiens
MQVLVSRIA

SEQ ID NO: 201834 - protein, 15 aa, Homo Sapiens
TPSAINGNPSWHLAD

SEQ ID NO: 201835 - protein, 9 aa, Homo Sapiens
INGNPSWHL

SEQ ID NO: 201836 - protein, 15 aa, Homo Sapiens
PSAINGNPSWHLADS

SEQ ID NO: 201837 - protein, 9 aa, Homo Sapiens
INGNPSWHL

SEQ ID NO: 201838 - protein, 15 aa, Homo Sapiens
VLVSRIAAWMATYLN

SEQ ID NO: 201839 - protein, 9 aa, Homo Sapiens
VLVSRIAAW

SEQ ID NO: 201840 - protein, 15 aa, Homo Sapiens
SAINGNPSWHLADSP

SEQ ID NO: 201841 - protein, 9 aa, Homo Sapiens
INGNPSWHL

SEQ ID NO: 201842 - protein, 15 aa, Homo Sapiens
LRYRRAFSDLTSQLH

SEQ ID NO: 201843 - protein, 9 aa, Homo Sapiens
YRRAFSDLT

SEQ ID NO: 201844 - protein, 15 aa, Homo Sapiens
RYRRAFSDLTSQLHI

SEQ ID NO: 201845 - protein, 9 aa, Homo Sapiens
FSDLTSQLH

SEQ ID NO: 201846 - protein, 15 aa, Homo Sapiens
YRRAFSDLTSQLHIT

SEQ ID NO: 201847 - protein, 9 aa, Homo Sapiens
FSDLTSQLH

SEQ ID NO: 201848 - protein, 15 aa, Homo Sapiens
INGNPSWHLADSPAV

SEQ ID NO: 201849 - protein, 9 aa, Homo Sapiens
INGNPSWHL

SEQ ID NO: 201850 - protein, 15 aa, Homo Sapiens
PSWHLADSPAVNGAT

SEQ ID NO: 201851 - protein, 9 aa, Homo Sapiens
WHLADSPAV

SEQ ID NO: 201852 - protein, 15 aa, Homo Sapiens
NPSWHLADSPAVNGA

SEQ ID NO: 201853 - protein, 9 aa, Homo Sapiens
WHLADSPAV

SEQ ID NO: 201854 - protein, 15 aa, Homo Sapiens
GNPSWHLADSPAVNG

SEQ ID NO: 201855 - protein, 9 aa, Homo Sapiens
WHLADSPAV

SEQ ID NO: 201856 - protein, 15 aa, Homo Sapiens
INGNPSWHLADSPAV

SEQ ID NO: 201857 - protein, 9 aa, Homo Sapiens
SWHLADSPA

SEQ ID NO: 201858 - protein, 15 aa, Homo Sapiens
NGNPSWHLADSPAVN

SEQ ID NO: 201859 - protein, 9 aa, Homo Sapiens
WHLADSPAV

SEQ ID NO: 201860 - protein, 15 aa, Homo Sapiens
SWHLADSPAVNGATG

SEQ ID NO: 201861 - protein, 9 aa, Homo Sapiens
WHLADSPAV

SEQ ID NO: 201862 - protein, 15 aa, Homo Sapiens
WHLADSPAVNGATGH

SEQ ID NO: 201863 - protein, 9 aa, Homo Sapiens
WHLADSPAV

SEQ ID NO: 201864 - protein, 15 aa, Homo Sapiens
RWFLTGMTVAGVVLL

SEQ ID NO: 201865 - protein, 9 aa, Homo Sapiens
FLTGMTVAG

SEQ ID NO: 201866 - protein, 15 aa, Homo Sapiens
WFLTGMTVAGVVLLG

SEQ ID NO: 201867 - protein, 9 aa, Homo Sapiens
MTVAGVVLL

SEQ ID NO: 201868 - protein, 15 aa, Homo Sapiens
FLTGMTVAGVVLLGS

SEQ ID NO: 201869 - protein, 9 aa, Homo Sapiens
MTVAGVVLL

SEQ ID NO: 201870 - protein, 15 aa, Homo Sapiens
KEMQVLVSRIAAWMA

SEQ ID NO: 201871 - protein, 9 aa, Homo Sapiens
MQVLVSRIA

SEQ ID NO: 201872 - protein, 15 aa, Homo Sapiens
FRDGVNWGRIVAFFS

SEQ ID NO: 201873 - protein, 9 aa, Homo Sapiens
GVNWGRIVA

SEQ ID NO: 201874 - protein, 15 aa, Homo Sapiens
DKEMQVLVSRIAAWM

SEQ ID NO: 201875 - protein, 9 aa, Homo Sapiens
MQVLVSRIA

SEQ ID NO: 201876 - protein, 15 aa, Homo Sapiens
VDKEMQVLVSRIAAW

SEQ ID NO: 201877 - protein, 9 aa, Homo Sapiens
MQVLVSRIA

SEQ ID NO: 201878 - protein, 15 aa, Homo Sapiens
RDGVNWGRIVAFFSF

SEQ ID NO: 201879 - protein, 9 aa, Homo Sapiens
GVNWGRIVA

SEQ ID NO: 201880 - protein, 15 aa, Homo Sapiens
SVDKEMQVLVSRIAA

SEQ ID NO: 201881 - protein, 9 aa, Homo Sapiens
MQVLVSRIA

SEQ ID NO: 201882 - protein, 15 aa, Homo Sapiens
MTVAGVVLLGSLFSR

SEQ ID NO: 201883 - protein, 9 aa, Homo Sapiens
VVLLGSLFS

SEQ ID NO: 201884 - protein, 15 aa, Homo Sapiens
TGMTVAGVVLLGSLF

SEQ ID NO: 201885 - protein, 9 aa, Homo Sapiens
MTVAGVVLL

SEQ ID NO: 201886 - protein, 15 aa, Homo Sapiens
FLTGMTVAGVVLLGS

SEQ ID NO: 201887 - protein, 9 aa, Homo Sapiens
MTVAGVVLL

SEQ ID NO: 201888 - protein, 15 aa, Homo Sapiens
GMTVAGVVLLGSLFS

SEQ ID NO: 201889 - protein, 9 aa, Homo Sapiens
MTVAGVVLL

SEQ ID NO: 201890 - protein, 15 aa, Homo Sapiens
RWFLTGMTVAGVVLL

SEQ ID NO: 201891 - protein, 9 aa, Homo Sapiens
FLTGMTVAG

SEQ ID NO: 201892 - protein, 15 aa, Homo Sapiens
LTGMTVAGVVLLGSL

SEQ ID NO: 201893 - protein, 9 aa, Homo Sapiens
MTVAGVVLL

SEQ ID NO: 201894 - protein, 15 aa, Homo Sapiens
WFLTGMTVAGVVLLG

SEQ ID NO: 201895 - protein, 9 aa, Homo Sapiens
MTVAGVVLL

SEQ ID NO: 201896 - protein, 15 aa, Homo Sapiens
DTFVELYGNNAAAES

SEQ ID NO: 201897 - protein, 9 aa, Homo Sapiens
VELYGNNAA

SEQ ID NO: 201898 - protein, 15 aa, Homo Sapiens
TFVELYGNNAAAESR

SEQ ID NO: 201899 - protein, 9 aa, Homo Sapiens
YGNNAAAES

SEQ ID NO: 201900 - protein, 15 aa, Homo Sapiens
FVELYGNNAAAESRK

SEQ ID NO: 201901 - protein, 9 aa, Homo Sapiens
YGNNAAAES

SEQ ID NO: 201902 - protein, 15 aa, Homo Sapiens
VELYGNNAAAESRKG

SEQ ID NO: 201903 - protein, 9 aa, Homo Sapiens
YGNNAAAES

SEQ ID NO: 201904 - protein, 15 aa, Homo Sapiens
TVAGVVLLGSLFSRK

SEQ ID NO: 201905 - protein, 9 aa, Homo Sapiens
VVLLGSLFS

SEQ ID NO: 201906 - protein, 15 aa, Homo Sapiens
ELYGNNAAAESRKGQ

SEQ ID NO: 201907 - protein, 9 aa, Homo Sapiens
YGNNAAAES

SEQ ID NO: 201908 - protein, 15 aa, Homo Sapiens
TVAGVVLLGSLFSRK

SEQ ID NO: 201909 - protein, 9 aa, Homo Sapiens
VLLGSLFSR

SEQ ID NO: 201910 - protein, 15 aa, Homo Sapiens
MTVAGVVLLGSLFSR

SEQ ID NO: 201911 - protein, 9 aa, Homo Sapiens
VVLLGSLFS

SEQ ID NO: 201912 - protein, 15 aa, Homo Sapiens
RELVVDFLSYKLSQK

SEQ ID NO: 201913 - protein, 9 aa, Homo Sapiens
LVVDFLSYK

SEQ ID NO: 201914 - protein, 15 aa, Homo Sapiens
ELVVDFLSYKLSQKG

SEQ ID NO: 201915 - protein, 9 aa, Homo Sapiens
FLSYKLSQK

SEQ ID NO: 201916 - protein, 15 aa, Homo Sapiens
KEMQVLVSRIAAWMA

SEQ ID NO: 201917 - protein, 9 aa, Homo Sapiens
MQVLVSRIA

SEQ ID NO: 201918 - protein, 15 aa, Homo Sapiens
DKEMQVLVSRIAAWM

SEQ ID NO: 201919 - protein, 9 aa, Homo Sapiens
MQVLVSRIA

SEQ ID NO: 201920 - protein, 15 aa, Homo Sapiens
RFNRWFLTGMTVAGV

SEQ ID NO: 201921 - protein, 9 aa, Homo Sapiens
FNRWFLTGM

SEQ ID NO: 201922 - protein, 15 aa, Homo Sapiens
SRIAAWMATYLNDHL

SEQ ID NO: 201923 - protein, 9 aa, Homo Sapiens
WMATYLNDH

SEQ ID NO: 201924 - protein, 15 aa, Homo Sapiens
FNRWFLTGMTVAGVV

SEQ ID NO: 201925 - protein, 9 aa, Homo Sapiens
LTGMTVAGV

SEQ ID NO: 201926 - protein, 15 aa, Homo Sapiens
LVVDFLSYKLSQKGY

SEQ ID NO: 201927 - protein, 9 aa, Homo Sapiens
FLSYKLSQK

SEQ ID NO: 201928 - protein, 15 aa, Homo Sapiens
NRELVVDFLSYKLSQ

SEQ ID NO: 201929 - protein, 9 aa, Homo Sapiens
LVVDFLSYK

SEQ ID NO: 201930 - protein, 15 aa, Homo Sapiens
VNWGRIVAFFSFGGA

SEQ ID NO: 201931 - protein, 9 aa, Homo Sapiens
IVAFFSFGG

SEQ ID NO: 201932 - protein, 15 aa, Homo Sapiens
SNRELVVDFLSYKLS

SEQ ID NO: 201933 - protein, 9 aa, Homo Sapiens
LVVDFLSYK

SEQ ID NO: 201934 - protein, 15 aa, Homo Sapiens
MQVLVSRIAAWMATY

SEQ ID NO: 201935 - protein, 9 aa, Homo Sapiens
LVSRIAAWM

SEQ ID NO: 201936 - protein, 15 aa, Homo Sapiens
VSRIAAWMATYLNDH

SEQ ID NO: 201937 - protein, 9 aa, Homo Sapiens
IAAWMATYL

SEQ ID NO: 201938 - protein, 15 aa, Homo Sapiens
EMQVLVSRIAAWMAT

SEQ ID NO: 201939 - protein, 9 aa, Homo Sapiens
VLVSRIAAW

SEQ ID NO: 201940 - protein, 15 aa, Homo Sapiens
RIAAWMATYLNDHLE

SEQ ID NO: 201941 - protein, 9 aa, Homo Sapiens
WMATYLNDH

SEQ ID NO: 201942 - protein, 15 aa, Homo Sapiens
NELFRDGVNWGRIVA

SEQ ID NO: 201943 - protein, 9 aa, Homo Sapiens
LFRDGVNWG

SEQ ID NO: 201944 - protein, 15 aa, Homo Sapiens
QVVNELFRDGVNWGR

SEQ ID NO: 201945 - protein, 9 aa, Homo Sapiens
LFRDGVNWG

SEQ ID NO: 201946 - protein, 15 aa, Homo Sapiens
VVNELFRDGVNWGRI

SEQ ID NO: 201947 - protein, 9 aa, Homo Sapiens
LFRDGVNWG

SEQ ID NO: 201948 - protein, 15 aa, Homo Sapiens
IAAWMATYLNDHLEP

SEQ ID NO: 201949 - protein, 9 aa, Homo Sapiens
WMATYLNDH

SEQ ID NO: 201950 - protein, 15 aa, Homo Sapiens
WGRIVAFFSFGGALC

SEQ ID NO: 201951 - protein, 9 aa, Homo Sapiens
IVAFFSFGG

SEQ ID NO: 201952 - protein, 15 aa, Homo Sapiens
NWGRIVAFFSFGGAL

SEQ ID NO: 201953 - protein, 9 aa, Homo Sapiens
IVAFFSFGG

SEQ ID NO: 201954 - protein, 15 aa, Homo Sapiens
QERFNRWFLTGMTVA

SEQ ID NO: 201955 - protein, 9 aa, Homo Sapiens
FNRWFLTGM

SEQ ID NO: 201956 - protein, 15 aa, Homo Sapiens
ERFNRWFLTGMTVAG

SEQ ID NO: 201957 - protein, 9 aa, Homo Sapiens
FNRWFLTGM

SEQ ID NO: 201958 - protein, 15 aa, Homo Sapiens
GRIVAFFSFGGALCV

SEQ ID NO: 201959 - protein, 9 aa, Homo Sapiens
IVAFFSFGG

SEQ ID NO: 201960 - protein, 15 aa, Homo Sapiens
VVDFLSYKLSQKGYS

SEQ ID NO: 201961 - protein, 9 aa, Homo Sapiens
FLSYKLSQK

SEQ ID NO: 201962 - protein, 15 aa, Homo Sapiens
VDKEMQVLVSRIAAW

SEQ ID NO: 201963 - protein, 9 aa, Homo Sapiens
MQVLVSRIA

SEQ ID NO: 201964 - protein, 15 aa, Homo Sapiens
AAWMATYLNDHLEPW

SEQ ID NO: 201965 - protein, 9 aa, Homo Sapiens
WMATYLNDH

SEQ ID NO: 201966 - protein, 15 aa, Homo Sapiens
QSNRELVVDFLSYKL

SEQ ID NO: 201967 - protein, 9 aa, Homo Sapiens
LVVDFLSYK

SEQ ID NO: 201968 - protein, 15 aa, Homo Sapiens
VNELFRDGVNWGRIV

SEQ ID NO: 201969 - protein, 9 aa, Homo Sapiens
LFRDGVNWG

SEQ ID NO: 201970 - protein, 15 aa, Homo Sapiens
GVNWGRIVAFFSFGG

SEQ ID NO: 201971 - protein, 9 aa, Homo Sapiens
VNWGRIVAF

SEQ ID NO: 201972 - protein, 15 aa, Homo Sapiens
ELFRDGVNWGRIVAF

SEQ ID NO: 201973 - protein, 9 aa, Homo Sapiens
LFRDGVNWG

SEQ ID NO: 201974 - protein, 15 aa, Homo Sapiens
GMTVAGVVLLGSLFS

SEQ ID NO: 201975 - protein, 9 aa, Homo Sapiens
VAGVVLLGS

SEQ ID NO: 201976 - protein, 15 aa, Homo Sapiens
EQVVNELFRDGVNWG

SEQ ID NO: 201977 - protein, 9 aa, Homo Sapiens
VVNELFRDG

SEQ ID NO: 201978 - protein, 15 aa, Homo Sapiens
RIVAFFSFGGALCVE

SEQ ID NO: 201979 - protein, 9 aa, Homo Sapiens
IVAFFSFGG

SEQ ID NO: 201980 - protein, 15 aa, Homo Sapiens
NRWFLTGMTVAGVVL

SEQ ID NO: 201981 - protein, 9 aa, Homo Sapiens
LTGMTVAGV

SEQ ID NO: 201982 - protein, 15 aa, Homo Sapiens
LRYRRAFSDLTSQLH

SEQ ID NO: 201983 - protein, 9 aa, Homo Sapiens
YRRAFSDLT

SEQ ID NO: 201984 - protein, 15 aa, Homo Sapiens
RYRRAFSDLTSQLHI

SEQ ID NO: 201985 - protein, 9 aa, Homo Sapiens
FSDLTSQLH

SEQ ID NO: 201986 - protein, 9 aa, Homo Sapiens
QLFEELQEL

SEQ ID NO: 201987 - protein, 10 aa, Homo Sapiens
YLNDHLEPWI

SEQ ID NO: 201988 - protein, 9 aa, Artificial Sequence
  Irrelevant peptide
GLQHWVPEL

SEQ ID NO: 201989 - protein, 9 aa, Artificial Sequence
  nonsense peptide
GLAGDVSAV

SEQ ID NO: 201990 - protein, 9 aa, Human Cytomegalovirus
NLVPMVATV

SEQ ID NO: 201991 - protein, 9 aa, Human Immunodeficiency Virus (HIV)
ILKEPVHGV

SEQ ID NO: 201992 - protein, 9 aa, Artificial Sequence
  nonsense peptide
ALIAPVHAV

SEQ ID NO: 201993 - protein, 9 aa, Epstein-Barr Virus (EBV)
GLCTLVAML

SEQ ID NO: 201994 - protein, 9 aa, Human Cytomegalovirus
VTEHDTLLY

SEQ ID NO: 201995 - protein, 9 aa, Homo Sapiens
IVDCLTEMY

SEQ ID NO: 201996 - protein, 10 aa, Human Cytomegalovirus
TPRVTGGGAM

SEQ ID NO: 201997 - protein, 11 aa, Human Cytomegalovirus
RPHERNGFTVL

SEQ ID NO: 201998 - protein, 10 aa, Human Immunodeficiency Virus (HIV)
TPGPGVRYPL

SEQ ID NO: 201999 - protein, 14 aa, Homo Sapiens
GLNDIFEAQKIEWH

SEQ ID NO: 202000 - protein, 13 aa, Homo Sapiens
AGFKGEQGPKGEP

SEQ ID NO: 202001 - protein, 9 aa, Human Cytomegalovirus
QYDPVAALF

SEQ ID NO: 202002 - protein, 9 aa, Human Cytomegalovirus
VYALPLKML

SEQ ID NO: 202003 - protein, 9 aa, Haemophilus Influenza
GILGFVFTL

SEQ ID NO: 202004 - protein, 9 aa, Human Cytomegalovirus
IPSINVHHY

SEQ ID NO: 202005 - protein, 8 aa, Human Cytomegalovirus
GLCLVALM

SEQ ID NO: 202006 - protein, 9 aa, Homo Sapiens
ILAKFLHWL

SEQ ID NO: 202007 - protein, 9 aa, Homo sapiens
  MOD_RES 4: pivaloyl-modification
ILAKFLHWL

SEQ ID NO: 202008 - protein, 8 aa, EBV
RAKFKQLL

SEQ ID NO: 202009 - protein, 10 aa, Mycobacterium tuberculosis
MWAQDAAAMF

SEQ ID NO: 202010 - protein, 10 aa, Mycobacterium tuberculosis
AAERGPGQML

SEQ ID NO: 202011 - protein, 15 aa, Artificial Sequence
  Synthetic
SLNDIFEAQKIEWHE

SEQ ID NO: 202012 - protein, 15 aa, Artificial Sequence
  Synthetic
PQPQPKPQPKPEPET

SEQ ID NO: 202013 - protein, 25 aa, Mycobacterium tuberculosis
MAEMKTDAATLAQEAGNFERISGDL

SEQ ID NO: 202014 - protein, 25 aa, Mycobacterium tuberculosis
GNFERISGDLKTQIDQVESTAGSLQ

SEQ ID NO: 202015 - protein, 26 aa, Mycobacterium tuberculosis
DQVESTAGSLQGQWRGAAGTAAQAAV

SEQ ID NO: 202016 - protein, 25 aa, Mycobacterium tuberculosis
AAGTAAQAAVVRFQEAANKQKQELD

SEQ ID NO: 202017 - protein, 25 aa, Mycobacterium tuberculosis
AANKQKQELDEISTNIRQAGVQYSR

SEQ ID NO: 202018 - protein, 25 aa, Mycobacterium tuberculosis
IRQAGVQYSRADEEQQQALSSQMGF

SEQ ID NO: 202019 - protein, 20 aa, Mycobacterium tuberculosis
MTEQQWNFAGIEAAASAIQG

SEQ ID NO: 202020 - protein, 25 aa, Mycobacterium tuberculosis
SAIQGNVTSIHSLLDEGKQSLTKLA

SEQ ID NO: 202021 - protein, 25 aa, Mycobacterium tuberculosis
EGKQSLTKLAAAWGGSGSEAYQGVQ

SEQ ID NO: 202022 - protein, 25 aa, Mycobacterium tuberculosis
SGSEAYQGVQQKWDATATELNNALQ

SEQ ID NO: 202023 - protein, 25 aa, Mycobacterium tuberculosis
TATELNNALQNLARTISEAGQAMAS

SEQ ID NO: 202024 - protein, 25 aa, Mycobacterium tuberculosis
NLARTISEAGQAMASTEGNVTGMFA
